US006686188B2

(12) United States Patent
Gu et al.

(10) Patent No.: US 6,686,188 B2
(45) Date of Patent: Feb. 3, 2004

(54) POLYNUCLEOTIDE ENCODING A HUMAN MYOSIN-LIKE POLYPEPTIDE EXPRESSED PREDOMINANTLY IN HEART AND MUSCLE

(75) Inventors: Yizhong Gu, Sunnyvale, CA (US); Yonggang Ji, San Mateo, CA (US); Sharron Gaynor Penn, San Mateo, CA (US); David Kagen Hanzel, Palo Alto, CA (US); David Russell Rank, Fremont, CA (US); Wensheng Chen, Mountain View, CA (US); Mark E. Shannon, Livermore, CA (US)

(73) Assignee: Amersham PLC, Buckinghamshire (GB)

( * ) Notice: Subject to any disclaimer, the term of this patent is extended or adjusted under 35 U.S.C. 154(b) by 0 days.

(21) Appl. No.: 09/866,108

(22) Filed: May 25, 2001

(65) Prior Publication Data

US 2002/0048800 A1 Apr. 25, 2002

Related U.S. Application Data

(63) Continuation-in-part of application No. PCT/US01/00666, filed on Jan. 30, 2001, and a continuation-in-part of application No. PCT/US01/00667, filed on Jan. 30, 2001, and a continuation-in-part of application No. PCT/US01/00664, filed on Jan. 30, 2001, and a continuation-in-part of application No. PCT/US01/00669, filed on Jan. 30, 2001, and a continuation-in-part of application No. PCT/US01/00665, filed on Jan. 30, 2001, and a continuation-in-part of application No. PCT/US01/00668, filed on Jan. 30, 2001, and a continuation-in-part of application No. PCT/US01/00663, filed on Jan. 30, 2001, and a continuation-in-part of application No. PCT/US01/00662, filed on Jan. 30, 2001, and a continuation-in-part of application No. PCT/US01/00661, filed on Jan. 30, 2001, and a continuation-in-part of application No. PCT/US01/00670, filed on Jan. 30, 2001.
(60) Provisional application No. 60/207,456, filed on May 26, 2000, provisional application No. 60/234,687, filed on Sep. 21, 2000, provisional application No. 60/236,359, filed on Sep. 27, 2000, and provisional application No. 60/266,860, filed on Feb. 5, 2001.

(30) Foreign Application Priority Data

Oct. 4, 2000 (GB) .............................................. 0024263

(51) Int. Cl.[7] .......................... C12N 9/16; C12N 15/00; C12N 5/00; C07H 21/04
(52) U.S. Cl. ................. 435/196; 435/320.1; 435/287.2; 435/325; 435/419; 435/252.3; 435/254.11; 536/23.2; 536/23.5
(58) Field of Search ............................. 536/23.1, 23.2, 536/23.5, 24.31; 435/320.1, 196, 254.11, 325, 252.3, 287.2, 419; 514/44

(56) References Cited

U.S. PATENT DOCUMENTS

| 3,687,808 A | 8/1972 | Merigan, Jr. et al. |
| 3,980,986 A | 9/1976 | Baird et al. |
| 4,246,774 A | 1/1981 | Flesselles et al. |
| 4,469,863 A | 9/1984 | Ts'o et al. |
| 4,476,301 A | 10/1984 | Imbach et al. |
| 4,708,871 A | 11/1987 | Geysen |
| 5,023,243 A | 6/1991 | Tullis |
| 5,034,506 A | 7/1991 | Summerton et al. |
| 5,166,315 A | 11/1992 | Summerton et al. |
| 5,177,196 A | 1/1993 | Meyer, Jr. et al. |
| 5,185,444 A | 2/1993 | Summerton et al. |
| 5,186,042 A | 2/1993 | Miyazaki |
| 5,188,897 A | 2/1993 | Suhadolnik et al. |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,071 A | 12/1993 | Chappel |
| 5,276,019 A | 1/1994 | Cohen et al. |
| 5,278,302 A | 1/1994 | Caruthers et al. |

(List continued on next page.)

FOREIGN PATENT DOCUMENTS

| WO | WO 84/03564 | 9/1984 |
| WO | WO 96/18412 | 6/1996 |
| WO | WO 96/32478 | 10/1996 |
| WO | WO 97/19193 | 5/1997 |
| WO | WO 97/34631 | 9/1997 |
| WO | WO 97/43316 | 11/1997 |
| WO | WO 98/12559 | 3/1998 |
| WO | WO 98/59360 | 12/1998 |
| WO | WO 98/59361 | 12/1998 |
| WO | WO 98/59362 | 12/1998 |
| WO | WO 99/58720 | 11/1999 |
| WO | WO 00/15779 | 3/2000 |
| WO | WO 00/26372 | 5/2000 |
| WO | WO 00/58473 | 10/2000 |
| WO | WO 00/77173 A1 | 12/2000 |
| WO | WO 01/57276 A1 | 8/2001 |

OTHER PUBLICATIONS

Seffernick et al. (2001) J Bacteriol 183:2405–2410.*

Lloyd, D., "Human DNA Sequence from Clone CTA–125H2 on Chromosome 22q11–12 Contains Part of the Gene for a Novel Protein Similar to KIAA0216 and Myosin Heavy Chain, ESTs, GSSs, and a CpG Island," *Database EMBL* (*Online*), Entry HS125H2, Accession No. Z98949 (Sep. 6, 1997).

(List continued on next page.)

Primary Examiner—Rebecca A. Prouty
Assistant Examiner—David J Steadman
(74) Attorney, Agent, or Firm—Fish & Neave; Daniel M. Becker; David A. Roise

(57) ABSTRACT

Presented are a novel myosin-like protein particularly expressed in human heart and muscle, isolated nucleic acids encoding the myosin-like protein, compounds and compositions derivable directly or indirectly therefrom, and diagnostic and therapeutic methods for using the same.

50 Claims, 19 Drawing Sheets

U.S. PATENT DOCUMENTS

| | | |
|---|---|---|
| 5,279,044 A | 1/1994 | Bremer |
| 5,286,717 A | 2/1994 | Cohen et al. |
| 5,321,131 A | 6/1994 | Agrawal et al. |
| 5,399,676 A | 3/1995 | Froehler |
| 5,405,938 A | 4/1995 | Summerton et al. |
| 5,405,939 A | 4/1995 | Suhadolnik et al. |
| 5,434,257 A | 7/1995 | Matteucci et al. |
| 5,445,934 A | 8/1995 | Fodor et al. |
| 5,453,496 A | 9/1995 | Caruthers et al. |
| 5,455,233 A | 10/1995 | Spielvogel et al. |
| 5,464,764 A | 11/1995 | Capecchi et al. |
| 5,466,677 A | 11/1995 | Baxter et al. |
| 5,470,967 A | 11/1995 | Huie et al. |
| 5,476,925 A | 12/1995 | Letsinger et al. |
| 5,487,992 A | 1/1996 | Capecchi et al. |
| 5,489,677 A | 2/1996 | Sanghvi et al. |
| 5,519,126 A | 5/1996 | Hecht |
| 5,527,695 A | 6/1996 | Hodges et al. |
| 5,536,821 A | 7/1996 | Agrawal et al. |
| 5,538,848 A | 7/1996 | Livak et al. |
| 5,539,082 A | 7/1996 | Nielsen et al. |
| 5,541,306 A | 7/1996 | Agrawal et al. |
| 5,541,307 A | 7/1996 | Cook et al. |
| 5,545,806 A | 8/1996 | Lonberg et al. |
| 5,545,807 A | 8/1996 | Surani et al. |
| 5,550,111 A | 8/1996 | Suhadolnik et al. |
| 5,561,225 A | 10/1996 | Maddry et al. |
| 5,563,253 A | 10/1996 | Agrawal et al. |
| 5,569,825 A | 10/1996 | Lonberg et al. |
| 5,570,694 A | 11/1996 | Rometsch |
| 5,571,799 A | 11/1996 | Tkachuk et al. |
| 5,587,361 A | 12/1996 | Cook et al. |
| 5,589,466 A | 12/1996 | Felgner et al. |
| 5,591,669 A | 1/1997 | Krimpenfort et al. |
| 5,595,915 A | 1/1997 | Geysen |
| 5,596,086 A | 1/1997 | Matteucci et al. |
| 5,602,240 A | 2/1997 | De Mesmaeker et al. |
| 5,608,046 A | 3/1997 | Cook et al. |
| 5,610,289 A | 3/1997 | Cook et al. |
| 5,614,396 A | 3/1997 | Bradley et al. |
| 5,618,704 A | 4/1997 | Sanghvi et al. |
| 5,623,070 A | 4/1997 | Cook et al. |
| 5,625,048 A | 4/1997 | Tsien et al. |
| 5,625,050 A | 4/1997 | Beaton et al. |
| 5,625,126 A | 4/1997 | Lonberg et al. |
| 5,627,052 A | 5/1997 | Schrader |
| 5,627,059 A | 5/1997 | Capecchi et al. |
| 5,631,153 A | 5/1997 | Capecchi et al. |
| 5,633,360 A | 5/1997 | Bischofberger et al. |
| 5,633,425 A | 5/1997 | Lonberg et al. |
| 5,661,016 A | 8/1997 | Lonberg et al. |
| 5,663,312 A | 9/1997 | Chaturvedula |
| 5,677,437 A | 10/1997 | Teng et al. |
| 5,677,439 A | 10/1997 | Weis et al. |
| 5,679,647 A | 10/1997 | Carson et al. |
| 5,693,761 A | 12/1997 | Queen et al. |
| 5,714,320 A | 2/1998 | Kool |
| 5,714,331 A | 2/1998 | Buchardt et al. |
| 5,719,262 A | 2/1998 | Buchardt et al. |
| 5,723,591 A | 3/1998 | Livak et al. |
| 5,731,181 A | 3/1998 | Kmiec |
| 5,741,668 A | 4/1998 | Ward et al. |
| 5,744,305 A | 4/1998 | Fodor et al. |
| 5,756,325 A | 5/1998 | Kmiec |
| 5,760,012 A | 6/1998 | Kmiec et al. |
| 5,766,886 A | 6/1998 | Studnicka et al. |
| 5,770,196 A | 6/1998 | Studnicka |
| 5,770,429 A | 6/1998 | Lonberg et al. |
| 5,777,079 A | 7/1998 | Tsien et al. |
| 5,780,296 A | 7/1998 | Holloman et al. |
| 5,789,650 A | 8/1998 | Lonberg et al. |
| 5,795,972 A | 8/1998 | Kmiec |
| 5,804,387 A | 9/1998 | Cormack et al. |
| 5,804,566 A | 9/1998 | Carson et al. |
| 5,807,715 A | 9/1998 | Morrison et al. |
| 5,814,318 A | 9/1998 | Lonberg et al. |
| 5,821,123 A | 10/1998 | Studnicka |
| 5,821,337 A | 10/1998 | Carter et al. |
| 5,824,269 A | 10/1998 | Kosaka et al. |
| 5,830,877 A | 11/1998 | Carson et al. |
| 5,843,913 A | 12/1998 | Li et al. |
| 5,846,726 A | 12/1998 | Nadeau et al. |
| 5,854,033 A | 12/1998 | Lizardi |
| 5,869,619 A | 2/1999 | Studnicka |
| 5,871,984 A | 2/1999 | Kmiec |
| 5,874,299 A | 2/1999 | Lonberg et al. |
| 5,874,304 A | 2/1999 | Zolotukhin et al. |
| 5,877,397 A | 3/1999 | Lonberg et al. |
| 5,880,104 A | 3/1999 | Li et al. |
| 5,888,983 A | 3/1999 | Kmiec et al. |
| 5,889,351 A | 3/1999 | Okumura et al. |
| 5,925,517 A | 7/1999 | Tyagi et al. |
| 5,930,143 A | 7/1999 | Savazzi |
| 5,939,598 A | 8/1999 | Kucherlapati et al. |
| 5,945,339 A | 8/1999 | Holloman et al. |
| 5,958,891 A | 9/1999 | Hsu et al. |
| 5,968,750 A | 10/1999 | Zolotukhin et al. |
| 5,981,214 A | 11/1999 | Skoultchi |
| 5,984,175 A | 11/1999 | Popp |
| 5,985,847 A | 11/1999 | Carson et al. |
| 5,990,689 A | 11/1999 | Poncon |
| 6,001,233 A | 12/1999 | Levy |
| 6,001,593 A | 12/1999 | Bandman et al. |
| 6,004,744 A | 12/1999 | Goelet et al. |
| 6,004,752 A | 12/1999 | Loewy et al. |
| 6,013,256 A | 1/2000 | Light et al. |
| 6,017,897 A | 1/2000 | Li et al. |
| 6,025,201 A | 2/2000 | Zelmanovic et al. |
| 6,027,881 A | 2/2000 | Pavlakis et al. |
| 6,046,800 A | 4/2000 | Ohtomo et al. |
| 6,048,524 A | 4/2000 | Selden et al. |
| 6,051,831 A | 4/2000 | Köster |
| 6,054,297 A | 4/2000 | Carter et al. |
| 6,054,321 A | 4/2000 | Tsien et al. |
| 6,063,630 A | 5/2000 | Treco et al. |
| 6,066,476 A | 5/2000 | Tsien et al. |
| 6,075,181 A | 6/2000 | Kucherlapati et al. |
| 6,090,919 A | 7/2000 | Cormack et al. |
| 6,096,548 A | 8/2000 | Stemmer |
| 6,096,865 A | 8/2000 | Michaels |
| 6,110,898 A | 8/2000 | Malone et al. |
| 6,114,598 A | 9/2000 | Kucherlapati et al. |
| 6,117,679 A | 9/2000 | Stemmer |
| 6,124,128 A | 9/2000 | Tsien et al. |
| 6,150,584 A | 11/2000 | Kucherlapati et al. |
| 6,162,963 A | 12/2000 | Kucherlapati et al. |
| 6,165,793 A | 12/2000 | Stemmer |
| 6,180,370 B1 | 1/2001 | Queen et al. |
| 6,180,377 B1 | 1/2001 | Morgan et al. |
| 6,180,406 B1 | 1/2001 | Stemmer |
| 6,187,305 B1 | 2/2001 | Treco et al. |
| 6,204,061 B1 | 3/2001 | Capecchi et al. |
| 6,204,250 B1 | 3/2001 | Bot et al. |

OTHER PUBLICATIONS

Lloyd, D., "BK125H2.1 (Novel Protein Similar to KIAA0216 and Myosin Heavy Chain) (Fragment)" *Database SWISSPROT* (Online), Entry/Acc. No. 060772 (Aug. 1, 1998).

Waye et al., "Hk594–f Adult Heart, Clontech *Homo Sapiens* cDNA Clone K594–f, mRNA," *Database EMBL (Online)*, Entry HS006124, Acc. No. R41006 (May 4, 2000).

Yokota et al., "*Homo Sapiens* bk125h2.1 mRNA, Complete CDs," *Database EMBL (Online)*, Entry/Acc. No. AB042648 (May 16, 2001).

Alers et al., "Universal Linkage System: An Improved Method for Labeling Archival DNA for Comparative Genomic Hybridization," *Genes, Chromosomes & Cancer*, vol. 25: pp. 301–305 (1999).

Bahler et al., "Are Class III and Class IX Myosins Motorized Signalling Molecules?" *Biochimica et Biophysica Acta 1496*:pp. 52–59 (2000).

Baker et al., "A Family of Unconventional Myosins from the Nematode *Caenorhabditis elegans*," *J. Mol. Biol.* vol. 272: pp. 523–535 (1997).

Baker et al., "Myosins: Matching Functions with Motors," *Current Opinion Cell Biology* vol. 10: pp. 80–86 (1998).

Banér et al., "More Keys to Padlock Probes: Mechanisms for High–Throughput Nucleic Acid Analysis," *Current Opinion in Biotechnology* vol. 12:pp. 11–15 (2001).

Bauer et al., "Human CLP36, a PDZ–Domain and LIM–Domain Protein, Binds to α–Actinin–1 and Associates with Actin Filaments and Stress Fibers in Activated Platelets and Endothelial Cells," *Blood* vol. 96 No. 13: pp. 4236–4245 (Dec. 15, 2000).

Brenner et al., "In Vitro Cloning of Complex Mixtures of DNA on Microbeads: Physical Separation of Differentially Expressed cDNAs," *Proc. Natl. Acad. Sci. USA* vol. 97 No. 4: pp. 1665–1670 (2000).

Brown, Susan S., "Myosins in Yeast," *Current Opinion in Cell Biology* vol. 9: pp. 44–48 (1997).

Chan et al., "Triplex DNA: Fundamentals, Advances, and Potential Applications for Gene Therapy," *J. Mol. Med.* vol. 75: pp. 267–282 (1997).

Clontech, *Retroviral Gene Transfer and Expression User Manual:* Jan. 11, 2001.

Culver et al., Correction of Chromosomal Point Mutations in Human Cells with Bifunctional Oligonucleotides, *Nature Biotechnology* vol. 17: pp. 989–993 (1999).

Escude et al., "Padlock Oligonucleotides for Duplex DNA Based on Sequence–Specific Triple Helix Formation," *Proc. Natl. Acad. Sci. USA* vol. 96: pp. 10603–10607 (1999).

Espreafico et al., "Primary Structure and Cellular Localization of Chicken Brain Myosin–V (p190), an Unconventional Myosin with Calmodulin Light Chains," *Journal of Cell Biology* vol. 119 No. 6: pp. 1541–1557 (Dec. 1992).

Finn et al., "Synthesis and Properties of DNA–PNA Chimeric Oligomers," *Nucleic Acids Research* vol. 24 No. 17: pp. 3357–3363 (1996).

Fox, Keith R., "Targeting DNA with Triplexes," *Current Medicinal Chemistry* vol. 7: pp. 17–37 (2000).

Furusawa et al., "Isolation of a Novel PDZ–Containing Myosin from Hematopoietic Supportive Bone Marrow Stromal Cell Lines," *Biochemical and Biophysical Research Communications* vol. 270: pp. 67–75 (2000).

Gamper et al., "The DNA Strand of Chimeric RNA/DNA Oligonecleotides Can Direct Gene Repair/Conversion Activity in Mammalian and Plant Cell–Free Extracts," *Nucleic Acids Research* vol. 28 No. 21:pp. 4332–4339 (2000).

Gautheret et al., "Alternate Polyadenylation in Human mRNAs: A Large–Scale Analysis by EST Clustering," *Genome Research* vol. 8: pp. 524–530 (1998).

Gee et al., "Single–Amino Acid Substitutions Alter the Specificity and Affinity of PDZ Domains for Their Legends," *Biochemistry* vol. 39: pp. 14638–14646 (2000).

Geysen et al., Use of Peptide Synthesis to Probe Viral Antigens for Epitopes to a Resolution of a Single Amino Acid, *Proc. Natl. Acad. Sci. USA* vol. 81: pp. 3998–4002 (Jul. 1984).

Gonnet et al., "Exhaustive Matching of the Entire Protein Sequence Database," *Science* vol. 256: pp. 1443–1445 (Jun. 5, 1992).

Harrington et al., "Formation of de novo Centromeres and Construction of First–Generation Human Artificial Microchromosomes," *Nature Genetics* vol. 15: pp. 345–355 (1997).

Hasson, Tama, "Unconventional Myosins, the Basis for Deafness in Mouse and Man," *Am. J. Hum. Genet.* vol. 61: pp. 801–805 (1997).

Heid et al., "Real Time Quantitative PCR," *Genome Research* vol. 6 No. 10: pp. 986–994 (1996).

Henegariu et al., "Custom Fluorescent–Nucleotide Synthesis as an Alternative Method for Nucleic Acid Labeling," *Nature Biotechnology* vol. 18: pp. 345–348 (Mar. 2000).

Henning et al., "Human Artificial Chromosomes Generated by Modification of a Yeast Artificial Chromosome Containing Both Human Alpha Satellite and Single–Copy DNA Sequences," *Proc. Natl. Acad. Sci. USA* vol. 96: pp. 592–597 (1999).

Holland et al., "Detection of Specific Polymerase Chain reaction Product by Utilizing the 5'→3' Exonuclease Activity of *Thermus Aquaticus* DNA Polymerase," *Proc. Natl. Acad. Sci. USA* vol. 88: pp. 7276–7280 (1991).

International Human Genome Sequencing Consortium, "Initial Sequencing and Analysis of the Human Genome," *Nature* vol. 409: pp. 860–921 (Feb. 15, 2001).

Jelsma et al., "Increase Labeling of DNA Probes for In Situ Hybridization with the Universal Linkage Systems (ULS)," *Journal of NIH Research* vol. 5: p. 82 (1994).

Kelley et al., "Mutation of MYH9, Encoding Non–Muscle Myosin Heavy Chain A, in May–Hegglin Anomaly," *Nature Genetics* vol. 26:106–108 (Sep. 2000).

Kochetkoca et al., "Triplex–Forming Oligonucleotides and Their Use in the Analysis of Gene Transcription," *Methods in Molecular Biology* vol. 130: pp. 189–201 (2000).

Kostrikis et al., "Spectral Genotyping of Human Alleles," *Science* vol. 279: pp. 1228–1229 (1998).

Kuimelis et al., "Structural Analogues of TaqMan Probes for Real–Time Quantitative PCR," *Nucleic Acids Symposium Series* No. 37: pp. 255–256 (1997).

Kuroiwa et al., "Manipulation of Human Minichromosomes to Carry Greater than Megabase–Sized Chromosome Inserts," *Nature Biotechnology* vol. 18: pp. 1086–1090 (Oct. 2000).

Lalwani et al., "Human Nonsyndromic Hereditary Deafness DFNA17 Is Due to a Mutation in Nonmuscle Myosin MYH9," *Am. J. Hum. Genet.* vol. 67: pp. 1121–1128 (2000).

Lander et al., "The Chipping Forecast," *Supplement to Nature Genetics* vol. 21 No. 1: pp. 1–60 (Jan. 1999).

Larsen et al., "Antisense Properties of Peptide Nucleic Acid," *Biochimica et Biophysica Acta* vol. 1489: pp. 159–166 (1999).

Lerner, "Tapping the immunological repertoire to produce antibodies of predetermined specificity," *Nature* vol. 299: pp. 592–596 (1982).

Lizardi et al., "Mutation Detection and Single–Molecule Counting Using Isothermal Rolling–Circle Amplification," *Nature Genetics* vol. 19: pp. 225–232 (1998).

Marras et al., "Multiplex Detection of Single–Nucleotide Variations Using Molecular Beacons," *Genetic Analysis: Biomolecular Engineering* vol. 14: pp. 151–156 (1999).

Misra et al., "Polyamide Nucleic Acid–DNA Chimera Lacking the Phosphate Backbone Arc Novel Primers for Polymerase Reaction Catalyzed by DNA Polymerases," *Biochemistry* vol. 37: pp. 1917–1925 (1998).

Nagase et al., "Predicting of the Coding Sequences of Unidentified Human Genes, VI. The Coding Sequences of 80 New Genes (KIAA0201–KIAA0280) Deduced by Analysis of cDNA Clones from Cell Line KG–1 and Brain," *DNA Research* vol. 3: pp. 321–329 (1996).

Nielsen, "Peptide Nucleic Acids as Therapeutic Agents," *Current Opinion in Structural Biology* vol. 9: pp. 353–357 (1999).

Nielsen et al., "Peptide Nucleid Acids: On the Road to New Gene Therapeutic Drugs," *Pharmacology & Toxicology* vol. 86: pp. 3–7 (2000).

Nielsen, "Applications of Peptide Nucleic Acids," *Current Opinion in Biotechnology* vol. 10: pp. 71–75 (1999).

Nilsson et al., "Padlock Probes: Cirularizing Oligonucleotides for Localized DNA Detection," *Science* vol. 265 No. 5181: pp. 2085–2088 (1994).

Praseuth et al., "Triple Helix Formation and the Antigene Strategy for Sequence–Specific Control of Gene Expression," *Biochimica et Biophysica Acta 1489:* pp. 181–206 (1999).

Ray et al., "Peptide Nucleic Acid (PNA): Its Medical and Biotechnical Applications and Promise for the Future," *The FASEB Journal* vol. 14: pp. 1041–1060 (Jun. 2000).

Redowicz, Maria J., "Myosins and Deafness," *Journal of Muscle Research & Cell Motility* vol. 20: pp. 241–248 (1999).

Schoner et al., "Translation of a Synthetic Two–Cistron mRNA in *Escherichia coli,*" *Proc. Natl. Acad. Sci. USA* vol. 83: pp. 8506–8510 (1986).

Schweitzer et al., "Combining Nucleic Acid Amplification and Detection," *Current Opinion in Biotechnology* vol. 12: pp. 21–27 (2001).

Sellers, James R., "Myosins: A Diverse Superfamily," *Biochimica et Biophysica Acta* 1496: pp. 3–22 (2000).

Shinnick et al., "Synthetic Peptide Immunogens as Vaccines," *Annual Review of Microbiology* vol. 37: pp. 425–446 (1983).

Shizuya et al., "The Development and Applications of the Bacterial Artificial Chromosome cloning System," *Keio J. Med.* vol. 50: pp. 26–30 (2001).

Shizuya et al., "Cloning and Stable Maintenance of 300–Kilobase–Pair Fragments of Human DNA in *Escherichia Coli* Using an F–Factor–Based Vector," *Proc. Natl. Acad. Sci. USA* vol. 89: pp. 8794–8797 (1992).

Sokol et al., "Real Time Detection of DNA–RNA Hybridization in Living Cells," *Proc. Natl. Acad. Sci. USA* vol. 95: pp. 11538–11543 (1998).

Sutcliffe et al., "Antibodies that react with predetermined sites on proteins," *Science* vol. 219: pp. 660–666 (1983).

Tatusova et al., "Blast 2 sequences—a new tool for comparing protein and nucleotides sequences," *FEMS Microbiology Letters* vol. 174: pp. 247–250 (1999).

Tyagi et al., "Molecular Beacons: Probes that Fluoresce upon Hybridization," *Nature Biotechnology* vol. 14: pp. 303–308 (1996).

Tyagi et al., "Multicolor Molecular Beacons for Allele Discrimination," *Nature Biotechnology* vol. 16: pp. 49–53 (1998).

Van Belkum et al., "Non–Isotopic Labeling of DNA by Newly Developed Hapten–Containing Platinum Compounds," *BioTechniques* vol. 16 No. 1: pp. 148–153 (1994).

\* cited by examiner cDNA: 1 - 8117 [SEQ ID NO:1]
CDS: 170 - 7876 [SEQ ID NO:2]
AA: [SEQ ID NO:3]

```
cacccggggagacgtcttagacagtcgtggttcctgtgatctgtgtcctctt     52 tgcagaagttctgtgtccatctcatgtgctgcgtgtgtctgtaaagcctcat    104 tccgtgctgtctggcaggaagctccatctcatctcatcatctcacggccctg    156

M   A   I   S   S   R   L   A   L      9
gcactgcctcagc ATG GCC ATC TCA TCA CGC CTC GCC CTG          196

W   E   Q   K   I   R   E   E   D   K   S   P   P       22
 TGG GAG CAG AAG ATT CGG GAA GAG GAC AAG AGC CCT CCA       235

P   S   S   P   P   P   L   F   S   V   I   P   G       35
 CCA TCC TCG CCC CCT CCT CTT TTC TCT GTC ATC CCA GGG       274

G   F   I   K   Q   L   V   R   G   T   E   K   E       48
 GGC TTC ATT AAG CAA CTG GTC CGG GGG ACT GAA AAA GAG       313

A   K   E   A   R   Q   R   K   Q   L   A   V   A       61
 GCC AAG GAA GCG AGA CAG AGG AAG CAG TTA GCT GTC GCC       352

S   P   E   R   E   I   P   E   I   S   I   S   Q       74
 TCT CCA GAA CGA GAG ATC CCA GAA ATT TCC ATC AGC CAA       391

P   N   S   K   S   S   S   G   T   R   S   G   S       87
 CCC AAC AGC AAG TCC AGC AGT GGC ACC AGA TCT GGA AGC       430

Q   Q   I   S   Q   D   D   Q   S   S   S   P   G      100
 CAG CAG ATC TCT CAG GAC GAC CAG TCA AGC TCT CCT GGG       469

S   S   D   I   L   G   K   E   S   E   G   S   R      113
 AGC TCA GAC ATT CTG GGC AAG GAG AGC GAG GGG TCC CGC       508

S   P   D   P   E   Q   M   T   S   I   N   G   E      126
 AGC CCC GAC CCT GAG CAG ATG ACA AGC ATC AAT GGT GAG       547

K   A   Q   E   L   G   S   S   A   T   P   T   K      139
 AAG GCC CAG GAG CTG GGC TCC AGT GCG ACA CCA ACC AAA       586

K   T   V   P   F   K   R   G   V   R   R   G   D      152
 AAG ACT GTC CCC TTC AAG AGG GGC GTG AGG AGG GGT GAT       625

V   L   L   M   V   A   K   L   D   P   D   S   A      165
 GTG TTG TTG ATG GTG GCC AAG CTG GAC CCG GAC TCA GCC       664

```
              AAG CCA GAG AAG ACT CAT CCC CAT GAC GCC CCC CCT TGC   703
               K   T   S   P   P   A   T   D   T   G   K   E   K   191
              AAG ACC TCT CCC CCC GCC ACA GAT ACT GGA AAG GAA AAG   742
               K   G   E   T   S   R   T   P   C   G   S   Q   A   204
              AAA GGG GAG ACC TCT AGG ACT CCT TGT GGC TCC CAG GCC   781
               S   T   E   I   L   A   P   K   A   E   K   T   R   217
              AGC ACC GAG ATC TTG GCC CCG AAA GCT GAG AAG ACC CGG   820
               T   G   G   L   G   D   P   G   Q   G   T   V   A   230
              ACT GGG GGT CTT GGG GAC CCA GGC CAA GGA ACT GTG GCA   859
               L   K   K   G   E   E   G   Q   S   I   V   G   K   243
              CTG AAA AAA GGC GAG GAG GGT CAA AGC ATA GTG GGG AAG   898
               G   L   G   T   P   K   T   T   E   L   K   E   A   256
              GGG CTT GGG ACC CCC AAG ACC ACA GAG CTG AAA GAG GCT   937
               E   P   Q   G   K   D   R   Q   G   T   R   P   Q   269
              GAG CCC CAG GGC AAA GAC AGG CAG GGG ACC AGG CCC CAA   976
               A   Q   G   P   G   E   G   V   R   P   G   K   A   282
              GCC CAA GGG CCC GGC GAG GGG GTG CGA CCA GGG AAA GCA   1015
               E   K   E   G   A   E   P   T   N   T   V   E   K   295
              GAG AAG GAG GGA GCA GAG CCC ACA AAC ACG GTG GAA AAG   1054
               G   N   V   S   K   D   V   G   S   E   G   K   H   308
              GGG AAT GTC TCT AAG GAC GTA GGG AGT GAA GGG AAG CAC   1093
               V   R   P   Q   I   P   G   R   K   W   G   G   F   321
              GTA AGG CCC CAA ATC CCT GGG AGA AAG TGG GGA GGT TTC   1132
               L   G   R   R   S   K   W   D   G   P   Q   N   K   334
              CTG GGA AGA AGG AGT AAG TGG GAC GGT CCC CAG AAT AAG   1171
               K   D   K   E   G   V   L   L   S   K   A   E   K   347
              AAG GAC AAA GAA GGG GTG CTC TTA AGT AAG GCA GAG AAG   1210
               T   G   E   P   Q   T   Q   M   E   K   T   S   Q   360
              ACA GGT GAG CCT CAG ACC CAG ATG GAG AAG ACA AGC CAA   1249
               V   Q   G   E   L   G   D   D   L   R   M   G   E   373
              GTG CAG GGC GAG TTG GGG GAC GAT CTG AGA ATG GGG GAG   1288
               K   A   G   E   L   R   S   T   T   G   K   A   G   386
              AAA GCA GGT GAG CTT CGG AGC ACG ACT GGG AAG GCA GGT   1327
               E   S   W   D   K   K   E   K   M   G   Q   P   Q   399
              GAG TCC TGG GAT AAG AAG GAA AAG ATG GGG CAA CCC CAG   1366
```

FIG. 2B

```
  G   K   S   G   N   A   G   E   A   R   S   Q   T    412
GGT AAG TCC GGG AAC GCA GGT GAA GCT CGG AGT CAG ACA   1405

E   K   G   C   E   A   P   K   E   V   S   T   M    425
GAG AAG GGC TGT GAA GCC CCA AAG GAG GTG AGC ACA ATG   1444

V   E   S   P   A   A   P   G   K   G   G   W   P    438
GTG GAG TCG CCA GCA GCT CCT GGG AAG GGA GGC TGG CCA   1483

G   S   R   G   Q   E   A   E   E   P   C   S   R    451
GGA AGC CGT GGG CAG GAA GCA GAG GAG CCC TGC TCA AGA   1522

A   G   D   G   A   G   A   L   E   T   E   L   E    464
GCA GGT GAT GGG GCT GGT GCC CTG GAG ACA GAG CTG GAA   1561

G   P   S   Q   P   A   L   E   K   D   A   E   R    477
GGA CCC AGC CAG CCT GCT CTG GAG AAG GAT GCA GAA AGG   1600

P   R   I   R   K   E   N   Q   D   G   P   A   P    490
CCT CGG ATA CGG AAG GAG AAC CAA GAC GGG CCA GCC CCG   1639

Q   E   E   G   K   G   G   Q   S   R   D   S   D    503
CAG GAG GAG GGC AAA GGA GGC CAG AGC AGA GAC TCA GAC   1678

Q   A   P   E   D   R   W   Y   E   A   E   K   V    516
CAG GCT CCT GAG GAC AGA TGG TAT GAG GCA GAG AAA GTC   1717

W   L   A   Q   K   D   G   F   T   L   A   T   V    529
TGG CTG GCT CAG AAG GAT GGA TTT ACT CTT GCT ACG GTG   1756

L   K   P   D   E   G   T   A   D   L   P   A   G    542
CTA AAG CCA GAT GAG GGA ACA GCA GAC CTG CCA GCA GGA   1795

R   V   R   L   C   I   D   A   D   K   T   I   T    555
AGG GTG AGA CTT TGC ATT GAT GCT GAC AAA ACC ATC ACT   1834

E   V   D   E   E   H   V   H   R   A   N   P   P    568
GAG GTG GAT GAG GAG CAT GTC CAT CGG GCC AAC CCT CCT   1873

E   L   D   Q   V   E   D   L   A   S   L   I   S    581
GAG CTG GAC CAG GTC GAG GAC CTG GCC TCT CTC ATC AGT   1912

V   N   E   S   S   V   L   N   T   L   L   Q   R    594
GTC AAC GAA TCC AGT GTC CTG AAC ACG CTT CTG CAG CGC   1951

Y   K   A   Q   L   L   H   T   C   T   G   P   D    607
TAC AAA GCT CAG CTG CTG CAC ACC TGC ACA GGG CCT GAT   1990

L   I   V   L   Q   P   R   G   P   S   V   P   S    620
CTG ATT GTC CTC CAG CCC CGG GGG CCC TCG GTG CCT TCT   2029
```

FIG. 2C

```
  A   G   K   V   P   K   G   R   R   D   G   L   P    633
 GCA GGG AAG GTG CCC AAG GGC CGC CGG GAT GGC CTG CCT  2068
  A   H   I   G   S   M   A   Q   R   A   Y   W   A    646
 GCC CAC ATT GGC TCC ATG GCA CAG CGG GCA TAC TGG GCG  2107
  L   L   N   Q   R   R   D   Q   S   I   V   A   L    659
 CTG CTG AAC CAG CGG AGA GAC CAG AGC ATT GTG GCC CTG  2146
  G   R   S   G   A   G   K   T   T   C   C   E   Q    672
 GGC CGG AGT GGC GCT GGG AAG ACC ACC TGC TGT GAG CAG  2185
  V   L   E   H   L   V   G   M   A   G   S   V   D    685
 GTC CTG GAA CAC CTG GTG GGG ATG GCA GGC AGT GTG GAT  2224
  G   R   V   S   V   E   K   I   R   A   T   F   T    698
 GGC AGG GTC TCA GTG GAG AAG ATC CGA GCC ACC TTC ACT  2263
  V   L   R   A   F   G   S   V   S   M   A   H   S    711
 GTC CTC CGG GCC TTC GGC TCT GTG TCC ATG GCC CAC AGC  2302
  R   S   A   T   R   F   S   M   V   M   S   L   D    724
 CGC AGT GCC ACC CGG TTC TCC ATG GTG ATG TCG CTG GAC  2341
  F   N   A   T   G   R   I   T   A   A   Q   L   Q    737
 TTC AAC GCT ACA GGC CGC ATC ACA GCT GCT CAG CTC CAG  2380
  T   M   L   L   E   K   S   R   V   A   R   Q   P    750
 ACA ATG CTT TTG GAG AAG AGC CGC GTG GCA CGG CAG CCG  2419
  E   G   E   S   N   F   L   V   F   S   Q   M   L    763
 GAA GGG GAA AGT AAC TTC CTG GTT TTC TCC CAG ATG CTG  2458
  A   G   L   D   L   D   L   R   T   E   L   N   L    776
 GCT GGA TTG GAC TTG GAT CTC AGG ACG GAG CTG AAC CTG  2497
  H   Q   M   A   D   S   S   F   G   M   G   V        789
 CAC CAG ATG GCA GAT AGC AGC TCC TTT GGC ATG GGC GTG  2536
  W   S   K   P   E   D   K   Q   K   A   A   A   A    802
 TGG TCC AAG CCT GAA GAT AAA CAG AAG GCG GCA GCT GCC  2575
  F   A   Q   L   Q   G   A   M   E   M   L   G   I    815
 TTT GCC CAG CTC CAG GGT GCC ATG GAG ATG CTG GGC ATC  2614
  S   E   S   E   Q   R   A   V   W   R   V   L   A    828
 TCA GAG AGC GAG CAG CGG GCT GTT TGG CGG GTC CTG GCA  2653
  A   I   Y   H   L   G   A   A   G   A   C   K   V    841
 GCC ATC TAC CAC CTG GGC GCG GCG GGG GCC TGC AAA GTG  2692
  G   R   K   Q   F   M   R   F   E   W   A   N   Y    854
```

FIG. 2D

```
                GGT CGG AAG CAG TTC ATG AGG TTT GAG TGG GCA AAC TAC  2731
  A   A   E   A   L   G   C   E   Y   E   E   L   N           867
GCA GCT GAG GCC CTG GGC TGC GAG TAT GAG GAG CTG AAC            2770
  T   A   T   F   K   H   H   L   R   Q   I   I   Q           880
ACG GCC ACC TTC AAG CAC CAC CTT CGA CAG ATC ATC CAG            2809
  Q   M   T   F   G   P   S   R   W   G   L   E   D           893
CAA ATG ACG TTT GGG CCA AGC CGA TGG GGC CTC GAG GAT            2848
  E   E   T   S   S   G   L   K   M   T   G   V   D           906
GAG GAA ACC AGC TCA GGG CTC AAG ATG ACA GGA GTG GAC            2887
  C   V   E   G   M   A   S   G   L   Y   Q   E   L           919
TGT GTG GAG GGG ATG GCC TCG GGC CTG TAC CAG GAA CTC            2926
  F   A   A   V   V   S   L   I   N   R   S   F   S           932
TTT GCG GCT GTG GTC TCA CTC ATC AAC AGA TCC TTT TCC            2965
  S   H   H   L   S   M   A   S   I   M   V   V   D           945
TCC CAC CAT CTC TCC ATG GCC TCC ATC ATG GTG GTG GAC            3004
  S   P   G   F   Q   N   P   R   H   Q   G   K   D           958
TCT CCA GGC TTC CAG AAC CCC CGG CAC CAG GGC AAG GAC            3043
  R   A   A   T   F   E   E   L   C   H   N   Y   A           971
CGG GCG GCC ACC TTT GAG GAG CTG TGC CAC AAC TAC GCC            3082
  H   E   R   L   Q   L   L   F   Y   Q   R   T   F           984
CAT GAG CGC CTG CAG CTG CTG TTC TAC CAG CGG ACC TTT            3121
  V   S   T   L   Q   R   Y   Q   E   E   G   V   P           997
GTC TCC ACG CTA CAG CGA TAT CAA GAG GAA GGT GTT CCT            3160
  V   Q   F   D   L   P   D   P   S   P   G   T   T          1010
GTG CAG TTT GAC CTC CCG GAC CCC TCC CCA GGG ACC ACC            3199
  V   A   V   V   D   Q   N   P   S   Q   Q   V   R          1023
GTG GCT GTT GTG GAT CAA AAT CCC TCT CAG CAG GTC CGC            3238
  L   P   A   G   G   G   A   Q   D   A   R   G   L          1036
TTA CCA GCT GGA GGA GGT GCC CAG GAT GCC AGA GGC CTT            3277
  F   W   V   L   D   E   E   V   H   V   E   G   S          1049
TTC TGG GTC TTA GAT GAG GAA GTC CAT GTA GAG GGC TCC            3316
  S   D   S   V   V   L   E   R   L   C   A   T   F          1062
AGT GAC AGT GTG GTG CTC GAG CGT CTG TGT GCT ACT TTC            3355
  E   K   K   G   A   G   T   E   G   S   S   A   L          1075
GAG AAG AAA GGA GCT GGG ACT GAA GGG TCC TCT GCC CTG            3394
```

FIG. 2E

```
      R   T   C   E   Q   P   L   Q   C   E   I   F   H   1088
    CGG ACC TGT GAG CAG CCC CTC CAG TGT GAG ATT TTC CAC 3433

Q   L   G   W   D   P   V   R   Y   D   L   T   G   1101
    CAG TTG GGA TGG GAC CCT GTG CGG TAC GAC CTC ACG GGC 3472

W   L   H   R   A   K   P   N   L   S   A   L   D   1114
    TGG CTC CAC AGA GCC AAG CCC AAC CTC TCG GCC CTG GAT 3511

A   P   Q   V   L   Q   Q   S   K   R   E   E   L   1127
    GCA CCC CAG GTC CTG CAA CAG TCA AAA AGA GAG GAG CTG 3550

R   S   L   F   Q   A   R   A   K   L   P   P   V   1140
    CGG AGT CTA TTC CAG GCC CGG GCC AAG CTG CCT CCT GTG 3589

C   R   A   V   A   G   L   E   G   T   S   Q   Q   1153
    TGC CGG GCT GTG GCA GGC CTG GAG GGC ACC TCC CAG CAG 3628

A   L   Q   R   S   R   M   V   R   R   T   F   A   1166
    GCC CTG CAG AGG AGC CGC ATG GTG AGG AGG ACC TTT GCC 3667

S   S   L   A   A   V   R   R   K   A   P   C   S   1179
    AGC AGC CTT GCC GCG GTG AGG AGG AAA GCC CCG TGC TCC 3706

Q   I   K   L   Q   M   D   A   L   T   S   M   I   1192
    CAG ATC AAG CTG CAG ATG GAT GCG CTG ACC AGC ATG ATC 3745

K   R   S   R   L   H   F   I   H   C   L   V   P   1205
    AAA AGG TCC CGG CTG CAC TTT ATC CAC TGC CTG GTA CCA 3784

N   P   V   V   E   S   R   S   G   Q   E   S   P   1218
    AAC CCT GTG GTG GAA AGC AGG AGT GGG CAG GAA TCT CCA 3823

P   P   P   Q   P   G   R   D   K   P   G   A   G   1231
    CCA CCA CCG CAG CCT GGT AGA GAC AAG CCT GGG GCA GGT 3862

G   P   L   A   L   D   I   P   A   L   R   V   Q   1244
    GGA CCT CTG GCC CTG GAT ATC CCA GCA CTG AGG GTC CAG 3901

L   A   G   F   H   I   L   E   A   L   R   L   H   1257
    CTT GCT GGG TTC CAC ATC CTG GAG GCT CTG CGT CTG CAT 3940

R   T   G   Y   A   D   H   M   G   L   T   R   F   1270
    AGG ACA GGC TAT GCT GAC CAC ATG GGG CTC ACT CGC TTC 3979

R   R   Q   F   Q   V   L   D   A   P   L   L   K   1283
    CGC CGG CAA TTC CAG GTG CTG GAC GCT CCA CTC CTG AAG 4018

K   L   M   S   T   S   E   G   I   D   E   R   K   1296
    AAG CTC ATG TCG ACC TCC GAG GGA ATA GAT GAA AGG AAG 4057
```

FIG. 2F

```
  A   V   E   E   L   L   E   T   L   D   L   E   K   1309
GCC GTG GAG GAG CTC CTG GAG ACC CTG GAT CTG GAA AAG  4096

K   A   V   A   V   G   H   S   Q   V   F   L   K   1322
AAG GCG GTG GCT GTG GGG CAC AGC CAA GTT TTT CTC AAG  4135

A   G   V   I   S   R   L   E   K   Q   R   E   K   1335
GCA GGT GTG ATC TCC AGG CTT GAG AAG CAG CGA GAG AAG  4174

L   V   S   Q   S   I   V   L   F   Q   A   A   C   1348
CTG GTA TCT CAG AGC ATC GTT CTC TTC CAG GCG GCT TGC  4213

K   G   F   L   S   R   Q   E   F   K   K   L   K   1361
AAG GGC TTT CTG TCT CGC CAG GAA TTC AAG AAG CTG AAG  4252

I   R   R   L   A   A   Q   C   I   Q   K   N   V   1374
ATT CGC CGA CTG GCT GCA CAG TGC ATC CAG AAG AAT GTG  4291

A   V   F   L   A   V   K   D   W   P   W   W   Q   1387
GCT GTG TTC CTC GCA GTC AAG GAC TGG CCA TGG TGG CAG  4330

L   L   G   S   L   Q   P   L   L   S   A   T   I   1400
CTG CTT GGT TCC CTC CAG CCT CTA CTT AGT GCC ACC ATT  4369

G   T   E   Q   L   R   A   K   E   E   E   L   T   1413
GGA ACT GAG CAG CTC CGA GCC AAG GAG GAG GAG CTT ACA  4408

T   L   R   R   K   L   E   K   S   E   K   L   R   1426
ACG CTA AGA CGG AAG CTA GAA AAA TCA GAG AAG TTG CGG  4447

N   E   L   R   Q   N   T   D   L   L   E   S   K   1439
AAT GAA CTC CGG CAG AAC ACA GAT CTG CTA GAA AGC AAG  4486

I   A   D   L   T   S   D   L   A   D   E   R   F   1452
ATT GCT GAC TTG ACC TCT GAC CTT GCC GAT GAG CGC TTC  4525

K   G   D   V   A   C   Q   V   L   E   S   E   R   1465
AAA GGT GAT GTG GCC TGC CAG GTG CTG GAG AGT GAG CGG  4564

A   E   R   L   Q   A   F   R   E   V   Q   E   L   1478
GCA GAG CGG CTA CAG GCC TTC CGG GAG GTC CAG GAG CTC  4603

K   S   K   H   E   Q   V   Q   K   K   L   G   D   1491
AAG AGC AAG CAT GAA CAA GTC CAG AAA AAA CTG GGA GAT  4642

V   N   K   Q   L   E   E   A   Q   Q   K   I   Q   1504
GTG AAT AAA CAG TTG GAA GAA GCC CAG CAG AAA ATT CAG  4681

L   N   D   L   E   R   D   P   T   G   G   A   D   1517
TTG AAT GAC TTG GAA AGG GAT CCC ACT GGA GGA GCA GAC  4720

```
                                                              GAG TGG CAG ATG CGC TTC GAC TGT GCT CAG ATG GAG AAC  4759
 E   F   L   R   K   R   L   Q   Q   C   E   E   R   1543
GAG TTC CTC AGA AAG CGT CTG CAG CAA TGC GAG GAG AGG           4798
 L   D   S   E   L   T   A   R   K   E   L   E   Q   1556
CTG GAC TCG GAG CTG ACA GCC AGG AAA GAG CTG GAG CAA           4837
 K   L   G   E   L   Q   S   A   Y   D   G   A   K   1569
AAG CTT GGG GAG TTG CAA AGT GCT TAT GAC GGG GCC AAG           4876
 K   M   A   H   Q   L   K   R   K   C   H   H   L   1582
AAG ATG GCT CAC CAA CTG AAG AGG AAG TGC CAC CAT CTT           4915
 T   C   D   L   E   D   T   C   V   L   L   E   N   1595
ACC TGT GAC CTT GAG GAT ACC TGC GTC CTG CTA GAG AAC           4954
 Q   Q   S   R   N   H   E   L   E   K   K   Q   K   1608
CAA CAA AGT CGA AAC CAT GAG CTG GAG AAG AAG CAG AAG           4993
 K   F   D   L   Q   L   A   Q   A   L   G   E   S   1621
AAG TTT GAC CTG CAG CTG GCC CAG GCC CTA GGT GAG TCA           5032
 V   F   E   K   G   L   R   E   K   V   T   Q   E   1634
GTG TTT GAG AAG GGT CTC CGT GAG AAA GTG ACC CAG GAG           5071
 N   T   S   V   R   W   E   L   G   Q   L   Q   Q   1647
AAC ACC AGT GTC CGG TGG GAG CTA GGC CAG CTT CAG CAG           5110
 Q   L   K   Q   K   E   Q   E   A   S   Q   L   K   1660
CAG CTG AAG CAA AAG GAG CAG GAA GCC TCA CAG CTG AAG           5149
 Q   Q   V   E   M   L   Q   D   H   K   R   E   L   1673
CAG CAG GTG GAG ATG CTA CAG GAC CAT AAA CGG GAG CTG           5188
 L   G   S   P   S   L   G   E   N   C   V   A   G   1686
CTG GGG TCA CCC TCT CTG GGG GAA AAT TGC GTT GCT GGC           5227
 L   K   E   R   L   W   K   L   E   S   S   A   L   1699
TTG AAG GAG AGG CTC TGG AAG TTG GAA TCC AGC GCC CTT           5266
 E   Q   Q   K   I   Q   S   Q   Q   E   N   T   I   1712
GAG CAA CAG AAA ATC CAG AGC CAG CAG GAA AAC ACC ATC           5305
 K   Q   L   E   Q   L   R   Q   R   F   E   L   E   1725
AAG CAG CTG GAG CAG CTC CGC CAG CGG TTT GAG CTG GAG           5344
 I   E   R   M   K   Q   M   H   Q   K   D   R   E   1738
ATC GAG CGG ATG AAG CAG ATG CAC CAG AAG GAC CGT GAG           5383
 D   Q   E   E   E   L   E   D   V   R   Q   S   C   1751
GAC CAG GAG GAG GAA CTG GAG GAT GTC CGT CAG TCC TGC           5422
```

FIG. 2H

```
  Q   K   R   L   H   Q   L   E   M   Q   L   E   Q   1764
CAG AAG CGG CTT CAT CAG CTG GAA ATG CAG CTG GAG CAA  5461

E   Y   E   E   K   Q   M   V   L   H   E   K   Q   1777
GAG TAT GAA GAG AAG CAG ATG GTC CTC CAT GAG AAG CAA  5500

D   L   E   G   L   I   G   T   L   C   D   Q   I   1790
GAT TTG GAA GGC TTG ATC GGA ACC CTC TGT GAC CAG ATT  5539

G   H   R   D   F   D   V   E   K   R   L   R   R   1803
GGC CAT CGG GAC TTT GAT GTG GAG AAG CGA CTT CGG AGA  5578

D   L   R   R   T   H   A   L   L   S   D   V   Q   1816
GAC CTC AGG AGG ACA CAT GCA CTG TTG TCA GAC GTG CAG  5617

L   L   L   G   T   M   E   D   G   K   T   S   V   1829
CTC CTT CTG GGC ACC ATG GAG GAT GGC AAG ACA TCA GTC  5656

S   K   E   E   L   E   K   V   H   S   Q   L   E   1842
AGC AAG GAG GAG CTG GAG AAA GTG CAC AGC CAG CTG GAG  5695

Q   S   E   A   K   C   E   E   A   L   K   T   Q   1855
CAG AGT GAA GCC AAG TGT GAG GAG GCC TTG AAG ACG CAG  5734

K   V   L   T   A   D   L   E   S   M   H   S   E   1868
AAG GTG CTC ACA GCG GAC CTG GAG AGC ATG CAC AGC GAG  5773

L   E   N   M   T   R   N   K   S   L   V   D   E   1881
CTG GAG AAC ATG ACG CGG AAC AAG AGC CTG GTG GAT GAG  5812

Q   L   Y   R   L   Q   F   E   K   A   D   L   L   1894
CAG CTG TAC AGG CTG CAG TTT GAG AAG GCG GAC CTC CTG  5851

K   R   I   D   E   D   Q   D   D   L   N   E   L   1907
AAG CGC ATC GAT GAG GAC CAG GAT GAC CTG AAT GAG CTG  5890

M   Q   K   H   K   D   L   I   A   Q   S   A   A   1920
ATG CAG AAG CAC AAG GAC CTC ATT GCT CAG TCT GCT GCT  5929

D   I   G   Q   I   Q   E   L   Q   L   Q   L   E   1933
GAC ATT GGG CAG ATC CAA GAA CTG CAG CTG CAG CTG GAG  5968

E   A   K   K   E   K   H   K   L   Q   E   Q   L   1946
GAA GCC AAG AAG GAG AAG CAC AAG CTA CAA GAA CAA CTG  6007

Q   V   A   Q   M   R   I   E   Y   L   E   Q   S   1959
CAG GTG GCT CAG ATG CGC ATC GAG TAC CTG GAA CAG TCC  6046

T   V   D   R   A   I   V   S   R   Q   E   A   V   1972
ACC GTG GAT CGA GCC ATC GTC AGC AGG CAG GAG GCG GTC  6085
```

FIG. 21

```
  I   C   D   L   E   N   K   T   E   F   Q   K   V   1985
ATC TGT GAC CTA GAG AAC AAG ACA GAG TTC CAG AAG GTG 6124

Q   I   K   R   F   E   V   L   V   I   R   L   R   1998
CAG ATT AAG AGA TTT GAG GTC CTG GTG ATC CGG CTT CGG 6163

D   S   L   I   K   M   G   E   E   L   S   Q   A   2011
GAC AGC CTG ATC AAG ATG GGG GAG GAG CTT TCA CAG GCG 6202

A   T   S   E   S   Q   Q   R   E   S   S   Q   Y   2024
GCC ACC TCC GAG TCC CAG CAG CGG GAG AGC AGC CAG TAC 6241

Y   Q   R   R   L   E   E   L   K   A   D   M   E   2037
TAC CAG CGG CGC CTG GAA GAG CTG AAG GCC GAC ATG GAA 6280

E   L   V   Q   R   E   A   E   A   S   R   R   C   2050
GAG CTG GTG CAG CGG GAG GCA GAG GCC AGC CGG CGG TGC 6319

M   E   L   E   K   Y   V   E   E   L   A   A   V   2063
ATG GAG CTG GAG AAG TAC GTG GAG GAA CTT GCA GCA GTG 6358

R   Q   T   L   Q   T   D   L   E   T   S   I   R   2076
AGG CAA ACC CTC CAG ACA GAC CTG GAG ACA TCC ATT CGG 6397

R   I   A   D   L   Q   A   A   L   E   E   V   A   2089
CGG ATT GCC GAC CTG CAG GCT GCC TTG GAA GAA GTG GCA 6436

S   S   D   S   D   T   E   S   V   Q   T   A   V   2102
TCC AGT GAC AGT GAT ACT GAG AGT GTC CAG ACG GCA GTG 6475

D   C   G   S   S   G   R   K   E   M   D   N   V   2115
GAT TGT GGC AGC AGC GGC CGA AAA GAG ATG GAT AAC GTC 6514

S   I   L   S   S   Q   P   E   G   S   L   Q   S   2128
TCC ATC CTC AGC TCC CAG CCA GAG GGC AGC CTG CAG TCC 6553

W   L   S   C   T   L   S   L   A   T   D   T   M   2141
TGG TTG AGC TGT ACT CTG TCC CTG GCC ACA GAT ACT ATG 6592

R   T   P   S   R   Q   S   A   T   S   S   R   I   2154
AGG ACT CCT TCT CGA CAG TCA GCC ACC AGC AGC CGC ATC 6631

L   S   P   R   I   N   E   E   A   G   D   T   E   2167
CTC AGC CCC AGG ATA AAC GAA GAG GCT GGG GAC ACT GAG 6670

R   T   Q   S   A   L   A   L   S   R   A   R   S   2180
AGG ACC CAG TCG GCA TTG GCA CTG AGC AGA GCC CGG TCC 6709

T   N   V   H   S   K   T   S   G   D   K   P   V   2193
ACC AAT GTC CAC AGC AAG ACC TCA GGA GAC AAG CCT GTT 6748

```
                    TC  CCC CAC TTT GTC CGC CGG CAA AAG TAC TGT CAT TTT  6787
     G   D   G   E   V   L   A   V   Q   R   K   S   T         2219
    GGG GAC GGC GAA GTG CTT GCC GTC CAG AGA AAG TCC ACA         6826
     E   R   L   E   P   A   S   S   P   L   A   S   R         2232
    GAG AGA TTA GAA CCT GCT TCC TCT CCC CTG GCT TCT CGG         6865
     S   T   N   T   S   P   L   S   R   E   K   L   P         2245
    AGT ACA AAT ACA TCC CCG CTG TCG AGG GAA AAG CTG CCC         6904
     S   P   S   A   A   L   S   E   F   V   E   G   L         2258
    AGT CCT TCA GCG GCC CTC TCG GAG TTC GTG GAA GGG CTC         6943
     R   R   K   R   A   Q   R   G   Q   G   S   T   L         2271
    CGG AGG AAG AGA GCC CAG AGA GGC CAG GGG TCC ACG CTG         6982
     G   L   E   D   W   P   T   L   P   I   Y   Q   T         2284
    GGC CTA GAG GAC TGG CCC ACT CTC CCC ATT TAC CAG ACG         7021
     T   G   A   S   T   L   R   R   G   R   A   G   S         2297
    ACT GGG GCC TCC ACA CTA AGG AGG GGC AGG GCT GGC AGT         7060
     D   E   G   N   L   S   L   R   V   G   A   K   S         2310
    GAC GAG GGA AAC CTC TCG CTG AGG GTT GGG GCA AAG TCA         7099
     P   L   E   I   E   G   A   A   G   G   L   L   R         2323
    CCC CTG GAA ATC GAA GGG GCC GCT GGT GGT CTC TTG AGG         7138
     S   T   S   L   K   C   I   S   S   D   G   V   G         2336
    TCC ACC AGC CTC AAA TGC ATC TCT TCA GAC GGT GTT GGG         7177
     G   T   T   L   L   P   E   K   S   K   T   Q   F         2349
    GGC ACA ACC CTA CTC CCC GAA AAG TCG AAA ACC CAA TTC         7216
     S   S   C   E   S   L   L   E   S   R   P   S   M         2362
    AGT TCC TGC GAG TCC CTC TTA GAA TCC AGA CCG AGC ATG         7255
     G   R   K   L   S   S   P   T   T   P   R   D   M         2375
    GGG AGA AAA CTG AGC TCT CCG ACC ACA CCC AGG GAC ATG         7294
     L   L   S   P   T   L   R   P   R   R   R   C   L         2388
    CTG TTG TCG CCC ACA CTG CGT CCT CGG AGG CGG TGT CTG         7333
     E   S   S   V   D   D   A   G   C   P   D   L   G         2401
    GAG TCC TCT GTG GAC GAT GCG GGC TGT CCA GAC CTT GGA         7372
     K   E   P   L   V   F   Q   N   R   Q   F   A   H         2414
    AAG GAG CCG CTT GTT TTC CAG AAC CGC CAG TTT GCC CAC         7411
     L   M   E   E   P   L   G   S   D   P   F   S   W         2427
    CTG ATG GAG GAA CCT CTA GGC AGT GAC CCA TTC AGC TGG         7450
```

FIG. 2K

```
     K   L   P   S   L   D   Y   E   R   K   T   K   V   2440
    AAA CTC CCA AGC CTC GAC TAC GAA CGC AAG ACC AAA GTG   7489
     D   F   D   D   F   L   P   A   I   R   K   P   Q   2453
    GAC TTC GAT GAC TTC CTC CCA GCT ATC CGG AAG CCC CAG   7528
     T   P   T   S   L   A   G   S   A   K   G   G   Q   2466
    ACA CCT ACC TCC TTG GCT GGA TCA GCC AAA GGT GGG CAA   7567
     D   G   S   Q   R   S   S   I   H   F   E   T   E   2479
    GAC GGT TCA CAG CGT TCA AGC ATC CAC TTT GAA ACG GAA   7606
     E   A   N   R   S   F   L   S   G   I   K   T   I   2492
    GAG GCT AAC CGT TCC TTT CTC TCG GGG ATC AAG ACC ATT   7645
     L   K   K   S   P   E   P   K   E   D   P   A   H   2505
    TTG AAG AAG AGC CCG GAG CCC AAG GAG GAT CCC GCT CAC   7684
     L   S   D   S   S   S   S   S   G   S   I   V   S   2518
    CTG TCT GAC TCG TCC TCA TCC TCC GGC TCC ATC GTG TCC   7723
     F   K   S   A   D   S   I   K   S   R   P   G   I   2531
    TTC AAA AGT GCT GAC AGC ATC AAA AGT CGA CCA GGA ATC   7762
     P   R   L   A   G   D   G   G   E   R   T   S   P   2544
    CCA CGA CTT GCG GGT GAC GGT GGC GAG CGA ACG TCC CCC   7801
     E   R   R   E   P   G   T   G   R   K   D   D   D   2557
    GAG CGG AGA GAG CCA GGG ACG GGG AGG AAA GAC GAC GAT   7840
     V   A   S   I   M   K   K   Y   L   Q   K   *       2569
    GTT GCG AGC ATA ATG AAG AAA TAC CTC CAG AAG TAG gaa   7879
    ccagttcagcctccttgaagctgcccttgaagacttcccgactctacaataa  7931
    cttggagacagagagactggccaggcctccccggtggccagagccagccagc  7983
    atggccaccctcaagaggcgagatgagcccacagaggcatatcctgcgggga  8035
    tgctgggctcccagtgtggttggcctgaacaaaataaagtgttgactcctgg  8087
    gcaaaaaaaaaaaaaaaaaaaaaaaaaaaa                        8117
```

FIG. 2L

```
HGDMLP-1   APEDRWYEAEKVWLAQKDGFTLATVLKPDEGTADLPAGRVRLCIDADKTITEVDEEHVHR  60
BAA93660   AAEEAWYETEKVWLVHRDGFSLASQLKSEE--LSLPEGKARVKLDHDGAILDVDEDDIEK  58
BAA13206   ------------------------------------------------------------

HGDMLP-1   ANPPELDQVEDLASLISVNESSVLNTLLQRYKAQLLHTCTGPDLIVLQPRGP----SVPS  116
BAA93660   ANAPSCDRLEDLASLVYLNESSVLHTLRQRYGASLLHTYAGPSLLVLSTRGAPAVYSEKV  118
BAA13206   ------------------------------------------------------------

HGDMLP-1   AGKVPKGRRDGLPAHIGSMAQRAYWALLNQRRDQSIVALGRSGAGKTTCCEQVLEHLVGM  176
BAA93660   MHMFKGCRREDMAPHIYAVAQTAYRAMLMSRQDQSIVLLGSSGSGKTTSFQHLVQYLATI  178
BAA13206   MHMFKGCRREDMAPHIYAVAQTAYRAMLMSRQDQSIILLGSSGSGKTTSCQHLVQYLATI  60
                 **  :.:,.**  ::** ** *.* *.**** ** **.****  :::::*. :

HGDMLP-1   AGSVDGRVS-VEKIRATFTVLRAFGSVSMAHSRSATRFSMVMSLDFNATGRITAAQLQTM  235
BAA93660   AGTSGTKVFSVEKWQALSTLLEAFGNSPTIMNGSATRFSQILSLDFDQAGQVASASIQTM  238
BAA13206   AGISGNKVFSVEKWQALYTLLEAFGNSPTIINGNATRFSQILSLDFDQAGQVASASIQTM  120
           ** .:* ***.**  *.* ***  . .    .***** ::****: .*.:::*.:***

HGDMLP-1   LLEKSRVARQPEGESNFLVFSQMLAGLDLDLRTELNLHQMADSSSFGMGVWSKPEDKQKA  295
BAA93660   LLEKLRVARRPASEATFNVFYYLLACGDATLRTELHLNHLAENNVFGIVPLSKPEEKQKA  298
BAA13206   LLEKLRVARRPASEATFNVFYYLLACGDGTLRTELHLNHLAENNVFGIVPLAKPEEKQKA  180
           **** ****.*  .* * ** :::* *  * ***** *::.:*;.. **: :***.****

HGDMLP-1   AAAFAQLQGAMEMLGISESEQRAVWRVLAAIYHLGAAG----ACKVGRKQFMRFEWANYA  351
BAA93660   AQQFSKLQAAMKVLAISPEEQKTCWLILASIYHLGAAGATKEAAEAGRKQFARHEWAQKA  358
BAA13206   AQQFSKLQAAMKVLGISPDEQKACWFILAAIYHLGAAGATKEAAEAGRKQFARHEWAQKA  240
           *  *::** **:.** ** . **:: * *.:************ *.:: ***** * **: *

HGDMLP-1   AEALGCEYEELNTATFKHHLRQIIQQMTFGPSRWGLEDEETSSGL--KMTGVDCVEGMAS  409
BAA93660   AYLLGCSLEELSSAIFKHQLKGGTLQRSTS-FRQGPEESGLGEGT--KLSALECLEGMAS  415
BAA13206   AYLLGCSLEELSSAIFKHQHKGGTLQRSTS-FRQGPEESGLGDGTGPKLSALECLEGMAA  299
           * ***. ***..* ***:   * :,   *  ; ,*** *:.   ..* *::;:*.****:

HGDMLP-1   GLYQELFAAVVSLINRSFSSHHLSMASIMVVDSPGFQNPRHQGKDRAATFEELCHNYAHE  469
BAA93660   GLYSELFTLLISLVNRALKSSQHSLCSMMIVDTPGFQNPEWGGSARGASFEELCHNYAQD  475
BAA13206   GLYSELFTLLVSLVNRALKSSQHSLCSMMIVDTPGFQNPEQGGSARGASFEELCHNYTQD  359
           ***.***:  ::.:**.**::  : * :.*:.**::******  *. *.*******:::

HGDMLP-1   RLQLLFYQRTFVSTLQRYQEEGVPVQFDLPDPSPGTTVAVVDQNPSQQVRLPAGGGAQDA  529
BAA93660   RLQRLFHERTFLQELERYKEDNIELAFDDLEPVADDSVAAVDQ-ASH--LVRSLAHADEA  532
BAA13206   RLQRLFHERTFVQELERYKEENIELAFDDLEPPTDDSVAAVDQ-ASHQSLVRSLARTDEA  418
           *** **::***:. * **::: :       ** .. :* ***  *  :  : : ::::*

HGDMLP-1   RGLFWVLDEEVHVEGSSDSVVLERLCATFEKKGAGTEGSSALRTCEQPLQCEIFHQLGWD  589
BAA93660   RGLLWLLEEEALVPGATEDALLDRLFSYYGPQEGDKKGQSPLLRSSKPRHFLLGHSHGTN  592
BAA13206   RGLLWLLEEEALVPGASEDTLLERLFSYYGPQEGDKKGQSPLLHSSKPHHFLLGHSHGTN  478
           ***:*:*:.**   * * :: :**  :  * :::.  :.  :* * ..*  .* : *.*  *  ;

HGDMLP-1   PVRYDLTGWLHRAKPNLSALDAPQVLQQSKREELRSLFQARAKLPPVCR-AVAGLEGTSQ  648
BAA93660   WVEYNVAGWLNYTKQNPATQNAPRLLQDSQKKIISNLFLGRAGSATVLSGSIAGLEGGSQ  652
BAA13206   WVEYNVTGWLNYTKQNPATQNVPRLLQDSQKKIISNLFLGRAGSATVLSGSIAGLEGGSQ  538
            * :*::.***: :*.* ::: * ::*:*::: :.** .**. . * . ::*******

HGDMLP-1   QALQRSRMVRRTFASSLAAVRRKAPCSQIKLQMDALTSMIKRSRLHFIHCLVPNPV---V  705
BAA93660   LALRRATSMRKTFTTGMAAVKKKSLCIQIKLQVDALIDTIKRSKMHFVHCFLPVAEGWPG  712
BAA13206   LALRRATSMRKTFTTGMVAVKKKSLCIQMKLQVDALIDTIKKSKLHFVHCFLPVAEGWAG  598
           **:*:. .:*:**::::.**::*: * *:***:***. :**:*::**:***::*  *
```

FIG. 3A

```
HGDMLP-1    ESRSGQESPPPPQPGRDKPGAG----GPLALDIPALRVQLAGFHILEALRLHRTGYADHM  761
BAA93660    EPRSASSRRVSSSSELDLPPGDPCEAGLLQLDVSLLRAQLRGSRLLDAMRMYRQGYPDHM  772
BAA13206    EPRSASSRRVSSSSELDLPSGDHCEAGLLQLDVPLLRTQLRGSRLLDAMRMYRQGYPDHM  658
            *.**...    .... * .. ***.** * ..*.*.*.* *.***

HGDMLP-1    GLTRFRRQFQVLDAPLLKKLMSTSEGIDERKAVEELLETLDLEKKAVAVGHSQVFLKAGV  821
BAA93660    VFSEFRRRFDVLAPHLTKKHGRNYIVVDEKRAVEELLESLDLEKSSCCLGLSRVFFRAGT  832
BAA13206    VFSEFRRRFDVLAPHLTKKHGRNYIVVDERRAVEELLBCLDLEKSSCCMGLSRVFFRAGT  718
             :.***.*:.** . * **    . :**::******* **** .  ..* *:.**:.**

HGDMLP-1    ISRLEKQREKLVSQSIVLFQAACKGFLSRQEFKKLKIRRLAAQCIQKNVAVFLAVKDWPW  881
BAA93660    LARLEEQRDEQTSRHLTLFQAACRGYLARQHFKKRKIQDLAIRCVQKNIKKNKGVKDWPW  892
BAA13206    LARLEEQRDEQTSRNLTLFQAACRGYLARQHFKKRKIQDLAIRCVQKNIKKNKGVKDWPW  778
            :.***.**.:  .*: ****** *:*** ****:**. ** :  *:.***:     ******

HGDMLP-1    WQLLGSLQPLLSATIGTEQLRAKEEELTTLRRKLEKSEKLRNELRQNTDLLESKIADLTS  941
BAA93660    WKLFTTVRPLIQVQLSEEQIRNKDEEIQQLRSKLVEKERNELRLSSDRLETRISELTS   952
BAA13206    WKLFTTVRPLIEVQLSEEQIRNKDEEIQQLRSKLEKAEKERNELRLNSDRLESRISELTS  838
            *:*. :::.**:. :. *::*  * *:** **** **  *:* *.* **:.*::**

HGDMLP-1    DLADERFKGDVACQVLESERAERLQAPREVQELKSKHEQVQKKLGDVNKQLEEAQQKIQL 1001
BAA93660    ELTDERNTGESASQLLDAETAERLRTEKEMKELQTQYDALKKQMEVMEMEVMEARLIRAA 1012
BAA13206    ELTDERNTGESASQLLDAETAERLRAEKEMKELQTQYDALKKQMEVMEMEVMEARLIRAA  898
            :* ***  *.:  .*  *.:*.***:       **.     ::*  **     :  **

HGDMLP-1    N-DLERDPTGGADEWQMRFDCAQMENEFLRKRLQQ-CEERLDSELTARKELEQKLGELQS 1059
BAA93660    EINGEVDDDDAGGEWRLKYERAVREVDFTKKRLQQELEDKMEVEQQSRRQLERRLGDLQA 1072
BAA13206    EINGEVDDDDAGGEWRLKYERAVREVDFTKKRLQQEFEDKLEVEQQNKRQLERRLGDLQA  958
            :   * *    ..,**::::. * .:*  *****  *::: * .:    :..** **.**:

HGDMLP-1    AYDGAKKMAHQLKRKCHHLTCDLEDTCVLLENQQSRNHELEKKQKKFDLQLAQALGESVF 1119
BAA93660    DSDESQRALQQLKKKCQRLTAELQDTKLHLEGQQVRNHELEKKQRRFDSELSQAHEETQR 1132
BAA13206    DSEESQRALQQLKKKCQRLTAELQDTKLHLEGQQVRNHELEKKQRRFDSELSQAHEEAQR 1018
            :  ::   .:***:**.:**  .:** .:**  .  ** ********.:.**   *:**   *:

HGDMLP-1    EKGLREKVTQENTSVRWELGQLQQQLKQEQEASQLKQQVEMLQDHKRELLGSPSLGENC  1179
BAA93660    EKLQREKLQREKDMLLAEAFSLKQQMEEKDLDIAGFTQKVVSLEAELQDISSQESKDEAS 1192
BAA13206    EKLQREKLQREKDMLLAEAFSLKQQLEEKDMDIAGFTQKVVSLEAELQDISSQESKDEAS 1078
            **  ***. :*: :   *  *.:**::. :  *  *.*:   *: ::..*    * .*  .

HGDMLP-1    VAGLKERLWKLESSSALEQQKIQSQQENTIKQLEQLRQRFELEIERMKQMHQKDREDQEEE 1239
BAA93660    LAKVKKQLRDLEAKVKDQEEELDEQAGSIQMLEQAKLRLEMEMERMRQTHSKEMESRDEE 1252
BAA13206    LAKVKKQLRDLEAKVKDQEEELDEQAGTIQMLEQAKLRLEMEMERMRQTHSKEMESRDEE 1138
            :.* .*::*. .**:. .*: . :*: **:  *:*.*: *.**  *.*:   * :.:.**

HGDMLP-1    LEDVRQSCQKRLHQLEMQLEQEYEEKQMVLHEKQDLEGLIGTLCDQIGHRDFDVEKRLRR 1299
BAA93660    VEEARQSCQKKLKQMEVQLEBEYEDKQKALREKRELESKLSTLSDQVNQRDFESEKRLRK 1312
BAA13206    VEEARQSCQKKLKQMEVQLEEEYEDKQKVLREKRELEGKLATLSDQVNRRDFESEKRLRK 1198
            :*:.******:*:*:*:***.***:**  * ** :** .* ***.*:. ***.*****:

HGDMLP-1    DLRRTHALLSDVQLLLGTMEDGKTSVSKEELEKVHSQLEQSEAKCEEALKTQKVLTADLE 1359
BAA93660    DLKRTKALLADAQIMLDHLKN--NAPSKREIAQLKNQLEESEFTCAAAVKARKAMEVEME 1370
BAA13206    DLKRTKALLADAQLMLDHLKN--SAPSKREIAQLKNQLEESEFTCAAAVKARKAMEVEIE 1256
            **:**:***:*.*::*   :    . *:**.*:: ***:**  *  *:*::** * :*

HGDMLP-1    SMHSELENMTRNKSLVDEQLYRLQFEKADLLKRIDEDQDDLNELMQKHKDLIAQSAADIG 1419
BAA93660    DLHLQIDDIAKAKTALEEQLSRLQREKNEIQNRLEEDQEDMNELMKKHKAAVAQASRDMA 1430
BAA13206    DLHLQIDDIAKAKTALEEQLSRLQREKNEIQNRLEEDQEDMNELMKKHKAAVAQASRDLA 1316
            .:*  :::::::  *: :::*** *:  :.:** *** ****:***.  .*:*::* *..
```

FIG. 3B

```
HGDMLP-1   QIQELQLQLEEAKKEKHKLQEQLQVAQMRIEYLEQSTVDRAIVSRQEAVICDLENKTEFQ  1479
BAA93660   QMNDLQAQIEESNKEKQELQEKLQALQSQVEFLEQSMVDKSLVSRQEAKIRELETRLEFE  1490
BAA13206   QINDLQAQLEEANKEKQELQEKLQALQSQVEFLEQSMVDKSLVSRQEAKIRELETRLEFE  1376
           *:.:**  *:**::***:;.***.**.  *  *::*:*** **::;******  *  .**:  **:

HGDMLP-1   KVQIKRFEVLVIRLRDSLIKMGEELSQAATSESQQRESSQYYQRRLEELKADMEELVQRE  1539
BAA93660   KTQVKRLENLASRLKETMEKLTEERDQRAAAENREKEQNKRLQRQLRDTKEEMSELARKE  1550
BAA13206   RTQVKRLESLASRLKENMEKLTEERDQRIAAENREKEQNKRLQRQLRDTKEEMGELARKE  1436
           ;.*:**:*.* *. **:;.: *: ** .*  ;;:*..::*..:  **:*.:  * :* **.::*

HGDMLP-1   AEASRRCMELEKYVEELAAVRQTLQTDLETSIRRIADLQAALEEVASSDSDTESVQTAVD  1599
BAA93660   AEASRKKHELEMDLESLEAANQSLQADLKLAFKRIGDLQAAIEDEMESDENEDLINSEGD  1610
BAA13206   AEASRKKHELEMDLESLEAANQSLQADLKLAFKRIGDLQAAIEDEMESDENEDLINSEGD  1496
           *****:   ***  :*,* .*.  *:**:** :::**.*****:*:   .**.:  : :::   *

HGDMLP-1   CGSSGRKEMDNVSILSSQPEGSLQSWLSCTLSLATDTMRTPSRQSATSSRILSPRINEEA  1659
BAA93660   S--------DVDSELEDRVDG-VKSWLS--------KNKGPSK-----------------  1636
BAA13206   S--------DVDSELEDRVDG-VKSWLS--------KNKGPSK-----------------  1522
           .     *   *  *..: :*  ;;****          . : **;

HGDMLP-1   GDTERTQSALALSRARSTNVHSKTSGDKPVSPHFVRRQKYCHFGDGEVLAVQRKSTERLE  1719
BAA93660   ----------APSDDGSLKSSSPTSHWKPLAPDPSDDE--------------HDPVD    1669
BAA13206   ----------AASDDGSLKSSSPTSYWKSLAPDRSDDE--------------HDPLD    1555
                     * *  *:  : *  ** *.;:*.   :                    :  ::

HGDMLP-1   PASSPLASRSTNTSPLSREKLPSPSA  1745
BAA93660   SISRPRFSHSYLSDSDTEAKLTETSA  1695
BAA13206   NTSRPRYSHSYLSDSDTEAKLTETNA  1581
           .  *  *:*  ;.. :.  **....*
```

FIG. 3C

Sequences Aligned

Query: myocilin [Homo sapiens]: Length 504 (1 .. 504)

Sbjct: hGDMLP-1: Length 2568 (1 .. 2568)

Region of Optimal Alignment

```
Query:   82  RLDLEATKARLSSLESLLHQLTLDQAARPQETQEGLQRELGTLRRERDQ-LETQ---TRE  137
             R DL  T A LS ++ LL  +   + +E  E +  +L     +  ++ L+TQ   T +
Sbjct: 1802  RRDLRRTHALLSDVQLLLGTMEDGKTSVSKEELEKVHSQLEQSEAKCEEALKTQKVLTAD  1861

Query:  138  LETAYS---NLLRDKSVLEEEKKRLRQENENLARRLESSSQEVARL  180
             LE+ +S    N+ R+KS+++E+  RL+ E  +L +R++    ++ L
Sbjct: 1862  LESMHSELENMTRNKSLVDEQLYRLQFEKADLLKRIDEDQDDLNEL  1907
```

Statistics

Identities = 30/106 (28%), Positives = 58/106 (54%), Gaps = 7/106 (6%)

FIG. 4

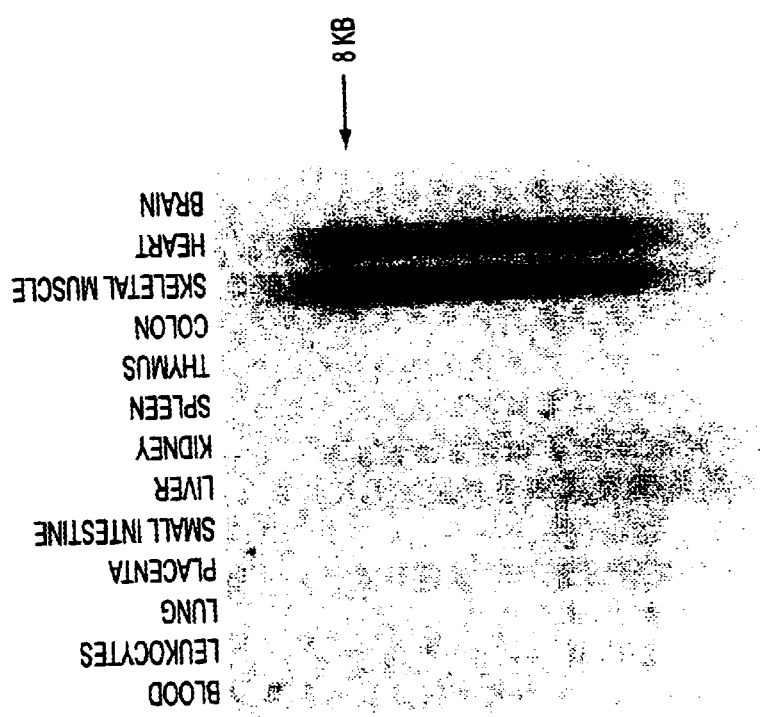

POLYNUCLEOTIDE ENCODING A HUMAN MYOSIN-LIKE POLYPEPTIDE EXPRESSED PREDOMINANTLY IN HEART AND MUSCLE

CROSS REFERENCE TO RELATED APPLICATIONS

This application claims priority under 35 U.S.C. §119(e) to provisional applications for U.S. Patent No. 60/207,456, filed May 26, 2000, No. 60/234,687, filed Sep. 21, 2000, No. 60/236,359, filed Sep. 27, 2000, and No. 60/266,860, filed Feb. 5, 2001, claims priority under 35 U.S.C. §365(c) and is a continuation-in-part of international application nos. PCT/US01/00666, PCT/US01/00667, PCT/US01/00664, PCT/US01/00669, PCT/US01/00665, PCT/US01/00668, PCT/US01/00663, PCT/US01/00662, PCT/US01/00661, PCT/US01/00670, all filed Jan. 30, 2001, and claims priority under 35 U.S.C. §119(a) to GB 0024263.6, filed Oct. 4, 2000, the disclosures of which are incorporated herein by reference in their entireties.

The present application includes a Sequence Listing filed herewith on a single (CD-R) compact disc, provided in duplicate. The Sequence Listing is presented in a single file named "amended sequence.txt", last modified Nov. 26, 2002 2:32:50 am, and having 2,312,956 bytes, the disclosure of which is incorporated herein by reference in its entirety.

FIELD OF THE INVENTION

The present invention relates to a novel myosin-like protein particularly expressed in human heart and muscle, isolated nucleic acids encoding the myosin-like protein, compounds and compositions derivable directly or indirectly therefrom, and diagnostic and therapeutic methods for using the same.

BACKGROUND OF THE INVENTION

Myosins are ubiquitous proteins that act as intracellular engines, typically motoring along tracks of actin filaments within the cell to drive a variety of cellular processes including muscular contraction, cytokinesis, membrane trafficking and signal transduction. Baker et al., *Curr. Opin. Cell Biol.* 10: 80–86 (1998). Given the range of intracellular passengers and itineraries, some form of the myosin protein is found in virtually all eukaryotic cells.

The myosin gene superfamily has at least seventeen members, or classes, encoded by multiple genes.

Mammalian cells have the largest number of myosin genes, with the 28 identified myosin genes belonging to nine classes. Sellers, *Biochim. Biophys. Acta* 1496: 3–22 (2000). The genome of the yeast, *Saccharomyces cerevisiae*, contains just 5 myosin genes. Brown, *Curr. Opin. Cell Biol.* 9: 44–48 (1997). Between these extremes, the nematode *Caenorhabditis elegans* has 14 identified myosin genes. Baker et al., *J. Mol. Biol.* 172: 523–535 (1997). Myosins are also found in plant cells, with myosin genes in classes VIII, XI and XIII expressed exclusively in plants.

The structure of myosin always includes one or two heavy chains and several light chains.

The heavy chain is composed of three structurally and functionally different domains. The head domain, which is highly conserved across the myosin family, functions to generate force, and contains actin-binding and ATP-binding sites; the ATPase activity of the head domain is activated by actin binding. The neck region, which mediates association with the light chains, regulates the adjacent head domain. The tail domain regulates the specific activity of each myosin.

The light chains of myosin I and myosin V are calmodulin, which is a calcium-binding regulatory subunit in certain enzymes. Myosin II is also regulated by calcium-binding light chains, but not calmodulin.

Together, the disparate myosin heavy and light chains permit myosins to serve disparate cellular roles.

For example, in brush border microvilli, myosin I, one of the two most abundant forms of myosin, links the microfilament bundles to the plasma membrane.

Myosin II, the other of the two most abundant myosin classes, forms dimers in muscle cells that associate to form thick filaments, which are part of the contractile apparatus.

In addition to its well characterized role in contraction and force production in skeletal, cardiac, and smooth muscles, myosin II is required for cytokinesis, cell motility, cell polarity/chemotaxis, maintaining cell architecture and development in nonmuscle cells. Sellers, *Biochim. Biophys. Acta* 1496:3–22 (2000).

Thus, contractile bundles, which comprise both actin and myosin II filaments, are found in numerous cell types. In epithelial cells, these bundles are called the circumferential belt and can function structurally (e.g., as an internal brace helping to control cell shape), or for motility (e.g., in wound healing, contraction seals the gap in a sheet of cells).

Myosin II is an integral component to the cytoskeletal substructure, acting to stiffen cortical membranes. In cytokinesis, myosin II plays an essential role performing the motor function for the contractile ring which constricts to form the cleavage furrow.

Myosin IXs, identified in rat, human and *C. elegans*, are expressed in a wide variety of tissues and cell types and are believed to be involved in intracellular signaling pathways. Myosin IX acts as a negative regulator of Rho (a G-protein), suggesting that it may control the Rho signaling pathways involved in cytoskeleton reorganization and other cellular processes. Bahler et al., *Biochim. Biophys. Acta* 1496:52–59 (2000). However the precise cellular functions of the myosin IXs and their exact roles in the Rho signaling pathways have still to be determined.

Membrane-bound myosins of various classes, particularly myosin I and myosin V, have been implicated in movement of vesicles within the cell. Due to its co-localization with Golgi membrane, myosin I is thought to move membrane vesicles between membrane compartments in the cytoplasm. Myosin I also serves as a membrane-microfilament linkage in microvilli.

In yet other examples of myosin function, protein secretion in yeast is disrupted by mutation in the myosin V gene, suggesting an important role for myosin V. In vertebrate brain tissue, myosin V is concentrated in the Golgi stacks and at the tips of membrane processes extending from neuronal cells. Espreafico et al., *J. Cell Biol.* 119: 1541 (1992). This type of membrane association would be consistent with the effects of myosin V mutations in mice, which adversely affect synaptic transmission, resulting in seizures and eventually death. In cell migration, different myosins localize to different regions of the cell. Myosin I localizes to the leading edge of a crawling amoeba, possibly participating in the translocation phase, whereas myosin II is more concentrated at the tail, where it is involved in retraction of the cell body.

Given their ubiquity, and the wide variety of tasks driven by myosins, it is not surprising that myosin defects have been implicated in a wide variety of diseases.

For example, as noted above, myosin V mutations in mice adversely affect synaptic transmission, resulting in seizures and eventually death.

Myosin and myosin-like genes have also been implicated in a number of human diseases.

For example, myosin plays a role in hypertrophic cardiomyopathy. An autosomally dominant form of the disease is frequently caused by a missense point mutation in exon 13 of the cardiac myosin heavy chain gene on chromosome 14. Less often, an abnormal cardiac myosin heavy chain hybrid gene is present.

As another example, mutation in the gene encoding myosin VIIA is responsible for some forms of Usher syndrome. Weil et al., *Nature* 374:60–61 (1995). Usher Syndrome is characterized by hearing impairment associated with retinitis pigmentosa.

Three classes of myosins, VI, VII and XV have been associated with genetic deafness disorders in mammals. Hasson, *Am. J. Hum. Genet.* 61:801–5 (1997); Redowicz, *J. Muscle Res. Cell Mot.* 20:241–248 (1999). Mutations in these myosins result in abnormalities in the stereocilia in the sensory cells of the inner ear of mice.

Other myosin-like genes may also be needed for normal stereociliary function in the inner ear, and mutations in these additional myosin-like genes may thus underlie or contribute to various forms of congenital deafness. For example, nonsyndromic hereditary deafness (DFNA17), mapped to chromosome 22q12.2-q13.3 in 1997, has now been associated with mutation in MYH9, a nonmuscle-myosin heavy-chain gene, located within the linked region. Lalwani et al., *Am. J. Hum. Genet.* 67:1121–8 (2000).

Despite the long-standing interest in myosins and sequence similarity among classes and across species, not all myosin and myosin-like genes have yet been identified, even in species that are genetically well characterized.

For example, a novel myosin-like gene (MysPDZ) has recently been cloned from mouse bone marrow stromal cells. The protein encoded by this newly identified gene contains a PDZ domain but no actin-binding domain. Furusawa et al., *Biochem. Biophys. Res. Comm.* 270: 67–75 (2000). PDZ domains are implicated in modular protein—protein interactions, also binding to specific C-terminal sequences of membrane proteins. Gee et al., *Biochem.* 39: 14638–46 (2000).

MysPDZ appears to localize in the cytoskeleton. Furusawa et al. show significant similarity between MysPDZ and a genomic clone from human chromosome 17; a human orthologue has been identified which contains an ATP/GTP-binding site. Nagase et al., *DNA Res.* 3: 321–329 (1996). Another PDZ-domain containing protein in humans has been shown to associate with actin filaments, possibly through binding to alpha-actinin. Bauer et al., *Blood* 96: 4236–45 (2000).

And in humans, genes for other new myosin-like proteins have recently been cloned. See, e.g., WO 00/26372, and U.S. Pat. No. 6,001,593, the disclosures of which is incorporated herein by reference in its entirety.

Given the importance of myosins in normal cellular processes and in disease, there is a need in the art for access to as yet undiscovered myosin and myosin-like genes.

Furthermore, diseases of the heart and vascular system are a significant cause of human morbidity and mortality. Increasingly, genetic factors are being found that contribute to predisposition, onset, and/or aggressiveness of most, if not all, of these diseases. There is a need for methods and apparatus that permit prediction, diagnosis and prognosis of diseases of the human heart.

SUMMARY OF THE INVENTION

These and other needs in the art are satisfied by the present invention, which provides compounds, compositions and methods based upon the identification and cloning of a novel human myosin-like protein, hGDMLP-1, which is expressed at high levels in human heart and also in skeletal muscle.

In a first aspect, the invention provides an isolated nucleic acid comprising: (i) the nucleotide sequence of SEQ ID NO:1, the full length cDNA sequence, (ii) the nucleotide sequence of SEQ ID NO:2, which presents the hGDMLP-1 cDNA open reading frame, (iii) a nucleotide sequence that is a degenerate variant of the nucleotide sequence of SEQ ID NO:2, (iv) a nucleotide sequence that encodes a polypeptide with the amino acid sequence of SEQ ID NO:3, which is the full length amino acid sequence of hGDMLP-1, (v) a nucleotide sequence that encodes a polypeptide with the amino acid sequence of SEQ ID NO:3 with conservative amino acid substitutions; (vi) a nucleotide sequence that encodes a polypeptide with the amino acid sequence of SEQ ID NO:3 with moderately conservative amino acid substitutions, or (vii) a nucleotide sequence that is the complement of the nucleotide sequence of any one of (i)–(vi).

As would be understood, the isolated nucleic acid that encodes hGDMLP-1 can be either genomic or transcript-derived.

The invention also provides an isolated nucleic acid comprising a nucleotide sequence that hybridizes under high stringency conditions to a probe, the sequence of which probe (i) consists of SEQ ID NO:2, (ii) encodes a polypeptide having the sequence of SEQ ID NO:3, (iii) encodes a polypeptide having the sequence of SEQ ID NO:3 with conservative amino acid substitutions, or (iv) is the complement of (i)–(iii), wherein the isolated nucleic acid is nonidentical in sequence to GenBank accession no. AA993492 and is less than 50 kb in length.

As further described below, GenBank accession no. AA993492 is an anonymous EST identical in sequence to portions of exons 15 and 16 of hGDMLP-1. By "nonidentity" is intended that the nucleic acid of the present invention have fewer, additional, or at least one nucleotide different from that of AA993492.

The invention further provides an isolated nucleic acid comprising a nucleotide sequence that hybridizes under moderate stringency conditions to a probe, the sequence of which probe (i) consists of SEQ ID NO:2, (ii) encodes a polypeptide having the sequence of SEQ ID NO:3, (iii) encodes a polypeptide having the sequence of SEQ ID NO:3 with conservative amino acid substitutions; or (iv) is the complement of (i)–(iii), wherein the isolated nucleic acid is nonidentical in sequence to GenBank accession no. AA993492 and is less than 50 kb in length.

In a related aspect, the invention provides an isolated nucleic acid comprising a nucleotide sequence that encodes at least 8 contiguous amino acids of SEQ ID NO:3, wherein the isolated nucleic acid is nonidentical in sequence to GenBank accession no. AA993492 and is less than 50 kb in length.

The invention also provides an isolated polynucleotide comprising a fragment of at least 17 nucleotides of the isolated nucleic acid of any one of claims 1–3, wherein the isolated nucleic acid is nonidentical in sequence to GenBank accession no. AA993492 and is less than 50 kb in length.

In useful embodiments of the isolated nucleic acids of the present invention, the isolated nucleic acid encodes a polypeptide having ATPase activity. In further useful embodiments, the isolated nucleic acids encode a polypeptide capable of binding calmodulin. Typically, the nucleic acids of the present invention are expressed in both skeletal muscle and heart muscle.

In another aspect, the invention provides the isolated nucleic acid molecule of the present invention operably linked to one or more expression control elements.

The invention further provides a replicable vector comprising an isolated nucleic acid molecule of the present invention.

In a further aspect, the invention provides a host cell transformed to contain the nucleic acid molecule of the present invention, or the progeny thereof.

In a related aspect, the invention provides a method for producing a polypeptide, the method comprising: culturing the transformed host cell of the present invention under conditions in which the protein encoded by the nucleic acid molecule is expressed.

Accordingly, the invention provides hGDMLP-1 polypeptides. In some embodiments, the polypeptide of the present invention is produced by the method described above.

In other embodiments, the invention provides an isolated polypeptide selected from the group consisting of: (a) an isolated polypeptide comprising the amino acid sequence of SEQ ID NO:3; (b) an isolated polypeptide comprising a fragment of at least 8 amino acids of SEQ ID NO: 3; (c) an isolated polypeptide according to (a) or (b) in which at least 95% of deviations from the sequence of (a) or (b) are conservative substitutions; and (d) an isolated polypeptide having at least 65% amino acid sequence identity to the isolated polypeptide of (a) or (b).

In another aspect, the invention provides an isolated antibody or antigen-binding fragment or derivative thereof, the binding of which can be competitively inhibited by a polypeptide of the present invention.

The invention also provides a method of identifying binding partners for a polypeptide according to the present invention, the method comprising: contacting the polypeptide to a potential binding partner; and determining if the potential binding partner binds to said polypeptide.

In another aspect, the invention provides a method of modulating the expression of a nucleic acid of the present invention, the method comprising: administering an effective amount of an agent which modulates the expression of the nucleic acid. The invention further provides a method of modulating at least one activity of a polypeptide according to the present invention, the method comprising: administering an effective amount of an agent which modulates at least one activity of a polypeptide according to the present invention.

In another aspect, the invention provides a transgenic non-human animal or transgenic plant modified to contain a nucleic acid molecule of the present invention and a transgenic non-human animal unable to express the orthologue of the polypeptide of the present invnetion.

In another aspect, the invention provides a method of diagnosing a disease caused by mutation in human hGDMLP-1, comprising: detecting the mutation in a sample of nucleic acids that derives from a subject suspected to have said disease.

In a further aspect, the invention provides a method of diagnosing or monitoring a disease caused by altered expression of human hGDMLP-1, comprising: determining the level of expression of human hGDMLP-1 in a sample of nucleic acids or proteins that derives from a subject suspected to have said disease, alterations from a normal level of expression providing diagnostic and/or monitoring information.

The invention further provides pharmaceutical compositions, including compositions separately comprising the nucleic acids, proteins, antibodies, antagonists and agonists of the present invention and a pharmaceutically acceptable excipient.

In a related aspect, the invention provides a method for treating or preventing a disorder associated with decreased expression or activity of human hGDMLP-1, the method comprising administering to a subject in need of such treatment an effective amount of the pharmaceutical composition comprising the nucleic acid, protein, or hGDMLP-1 agonist of the present invention.

Analogously, the invention further provides a method for treating or preventing a disorder associated with increased expression or activity of human hGDMLP-1, the method comprising administering to a subject in need of such treatment an effective amount of the pharmaceutical composition comprising an antibody or antagonist of the present invention.

The invention provides diagnostic compositions comprising, e.g., the nucleic acid, antibody, or polypeptide of the present invention, the nucleic acid being detectably labeled. In some embodiments, the diagnostic composition is suitable for in vivo administration.

In another embodiment, the invention provides the isolated nucleic acid molecule of the present invention attached to a substrate, and a microarray, at least one probe of which microarray is a nucleic acid according to the present invention.

The invention further provides a method for detecting a target nucleic acid in a sample, the target being a nucleic acid of the present invention, the method comprising: a) hybridizing the sample with a probe comprising at least 30 contiguous nucleotides of a sequence complementary to the target nucleic acid in the sample under hybridization conditions sufficient to permit detectable binding of said probe to said target, and b) detecting the presence or absence, and optionally the amount, of said binding.

The invention also provides a fusion protein, the fusion protein comprising a polypeptide of the present invention fused to a heterologous amino acid sequence. In certain particularly useful embodiments, the heterologous amino acid sequence is a detectable moiety, such as a fluorescent moiety. In other embodiments, the heterologous amino acid sequence is an Ig Fc region.

In yet another aspect, the invention provides a method of screening for agents that modulate the expression of human hGDMLP-1, the method comprising: contacting a cell or tissue sample believed to express human hGDMLP-1 with a chemical or biological agent, and then comparing the amount of human hGDMLP-1 expression with that of a control.

BRIEF DESCRIPTION OF THE DRAWINGS

The above and other objects and advantages of the present invention will be apparent upon consideration of the following detailed description taken in conjunction with the accompanying drawings, in which like characters refer to like parts throughout, and in which:

FIGS. 2A–2L collectively show the sequence of the cDNA encoding the human genome-derived myosin-like protein (hGDMLP-1) of the present invention (full-length cDNA (bases 1–8117)=SEQ ID NO:1; coding sequence (bases 170–7876)=SEQ ID NO:2), with its predicted amino acid sequence (SEQ ID NO:3);

FIGS. 3A–3C collectively show an alignment of residues 505–2249 of the hGDMLP-1 coding sequence of the present invention (SEQ ID NO:3) with the two closest known orthologues (BAA93660=SEQ ID NO:15753; BAA13206=SEQ ID NO:15754);

FIG. 4 shows an alignment of residues 1802–1907 of the amino acid sequence of hGDMLP-1 of the present invention (SEQ ID NO:3) and residues 82–180 of human myocilin (SEQ ID NO:15755);

FIG. 6 is a northern blot probed with a labeled fragment of hGDMLP-1, according to the present invention, showing muscle- and heart-specific expression of an 8 kb transcript corresponding to hGDMLP-1.

DETAILED DESCRIPTION OF THE INVENTION

Figure 1:
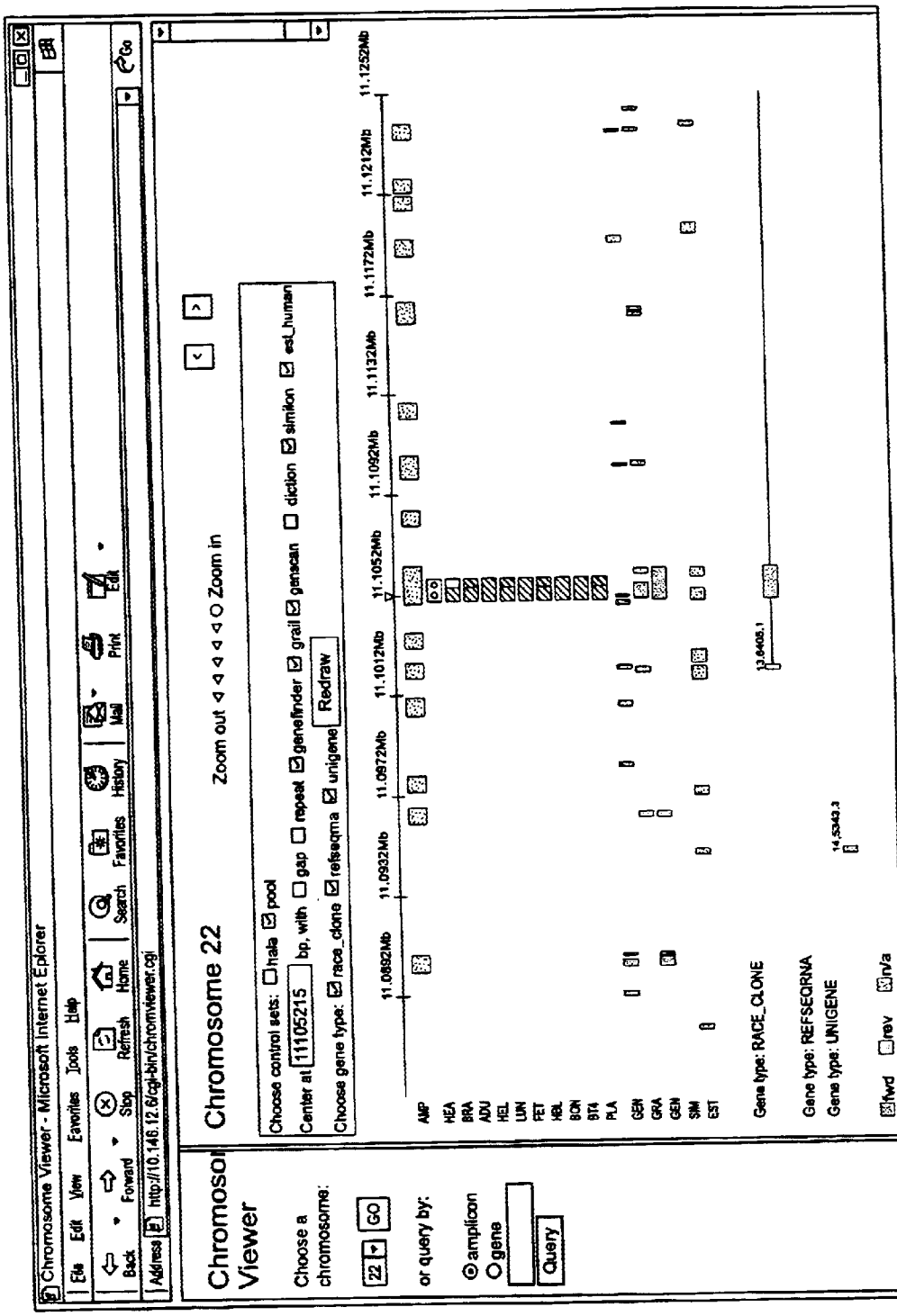
FIG. 1 is a screen shot of a graphical display that facilitates identification of exons in genomic sequence the expression of which meets user criteria, particularly identifying heart-specific expression of one exon of the gene of the present invention.

The present invention is based on the discovery of a new human myosin heavy chain-like protein, hGDMLP-1, the polynucleotides encoding hGDMLP-1, and the use of these compositions, inter alia, for the diagnosis, prevention, or treatment of disorders.

Definitions

Unless defined otherwise, all technical and scientific terms used herein have the meaning commonly understood by one of ordinary skill in the art to which this invention belongs. As used herein and in the appended claims, the singular forms "a", "an", and "the" include plural reference unless the context clearly dictates otherwise.

As used herein, "nucleic acid" (synonymously, "polynucleotide") includes polynucleotides having natural nucleotides in native 5'-3' phosphodiester linkage—e.g., DNA or RNA—as well as polynucleotides that have non-natural nucleotide analogues, nonnative internucleoside bonds, or both, so long as the nonnatural polynucleotide is capable of sequence-discriminating basepairing under experimentally desired conditions. Unless otherwise specified, the term "nucleic acid" includes any topological conformation; the term thus explicitly comprehends single-stranded, double-stranded, partially duplexed, triplexed, hairpinned, circular, and padlocked conformations.

As used herein, an "isolated nucleic acid" is a nucleic acid molecule that exists in a physical form that is nonidentical to any nucleic acid molecule of identical sequence as found in nature; "isolated" does not require, although it does not prohibit, that the nucleic acid so described has itself been physically removed from its native environment.

For example, a nucleic acid can be said to be "isolated" when it includes nucleotides and/or internucleoside bonds not found in nature. When instead composed of natural nucleosides in phosphodiester linkage, a nucleic acid can be said to be "isolated" when it exists at a purity not found in nature, where purity can be adjudged with respect to the presence of nucleic acids of other sequence, with respect to the presence of proteins, with respect to the presence of lipids, or with respect the presence of any other component of a biological cell, or when the nucleic acid lacks sequence that flanks an otherwise identical sequence in an organism's genome, or when the nucleic acid possesses sequence not identically present in nature.

As so defined, "isolated nucleic acid" includes nucleic acids integrated into a host cell chromosome at a heterologous site, recombinant fusions of a native fragment to a heterologous sequence, recombinant vectors present as episomes or as integrated into a host cell chromosome.

As used herein, an isolated nucleic acid "encodes" a reference polypeptide when at least a portion of the nucleic acid, or its complement, can be directly translated to provide the amino acid sequence of the reference polypeptide, or when the isolated nucleic acid can be used, alone or as part of an expression vector, to express the reference polypeptide in vitro, in a prokaryotic host cell, or in a eukaryotic host cell.

As used herein, the term "exon" refers to a nucleic acid sequence found in genomic DNA that is bioinformatically predicted and/or experimentally confirmed to contribute contiguous sequence to a mature mRNA transcript.

As used herein, the phrase "open reading frame" and the equivalent acronym "ORF" refer to that portion of a transcript-derived nucleic acid that can be translated in its entirety into a sequence of contiguous amino acids. As so defined, an ORF has length, measured in nucleotides, exactly divisible by 3. As so defined, an ORF need not encode the entirety of a natural protein.

As used herein, the phrase "ORF-encoded peptide" refers to the predicted or actual translation of an ORF.

As used herein, the phrase "degenerate variant" of a reference nucleic acid sequence intends all nucleic acid sequences that can be directly translated, using the standard genetic code, to provide an amino acid sequence identical to that translated from the reference nucleic acid sequence.

As used herein, the term "microarray" and the equivalent phrase "nucleic acid microarray" refer to a substrate-bound collection of plural nucleic acids, hybridization to each of the plurality of bound nucleic acids being separately detectable. The substrate can be solid or porous, planar or non-planar, unitary or distributed.

As so defined, the term "microarray" and phrase "nucleic acid microarray" include all the devices so called in Schena (ed.), *DNA Microarrays: A Practical Approach* (*Practical Approach Series*), Oxford University Press (1999) (ISBN: 0199637768); *Nature Genet.* 21(1)(suppl):1–60 (1999); and Schena (ed.), *Microarray Biochip: Tools and Technology*, Eaton Publishing Company/BioTechniques Books Division (2000) (ISBN: 1881299376), the disclosures of which are incorporated herein by reference in their entireties.

As so defined, the term "microarray" and phrase "nucleic acid microarray" include substrate-bound collections of plural nucleic acids in which the plurality of nucleic acids are distributably disposed on a plurality of beads, rather than on a unitary planar substrate, as is described, inter alia, in Brenner et al., *Proc. Natl. Acad. Sci. USA* 97(4):166501670 (2000), the disclosure of which is incorporated herein by reference in its entirety; in such case, the term "microarray" and phrase "nucleic acid microarray" refer to the plurality of beads in aggregate.

As used herein with respect to solution phase hybridization, the term "probe", or equivalently, "nucleic acid probe" or "hybridization probe", refers to an isolated nucleic acid of known sequence that is, or is intended to be, detectably labeled. As used herein with respect to a nucleic acid microarray, the term "probe" (or equivalently "nucleic acid probe" or "hybridization probe") refers to the isolated nucleic acid that is, or is intended to be, bound to the substrate. In either such context, the term "target" refers to nucleic acid intended to be bound to probe by sequence complementarity.

As used herein, the expression "probe comprising SEQ ID NO:X", and variants thereof, intends a nucleic acid probe, at least a portion of which probe has either (i) the sequence directly as given in the referenced SEQ ID NO:X, or (ii) a sequence complementary to the sequence as given in the referenced SEQ ID NO:X, the choice as between sequence directly as given and complement thereof dictated by the requirement that the probe be complementary to the desired target.

As used herein, the phrases "expression of a probe" and "expression of an isolated nucleic acid" and their linguistic equivalents intend that the probe (or, respectively, isolated nucleic acid), or a probe (or, respectively, isolated nucleic acid) complementary in sequence thereto, can hybridize detectably under high stringency conditions to a sample of nucleic acids that derive from mRNA transcripts from a given source. For example, and by way of illustration only, expression of a probe in "liver" means that the probe can hybridize detectably under high stringency conditions to a sample of nucleic acids that derive from mRNA obtained from liver.

As used herein, "a single exon probe" comprises at least part of an exon ("reference exon") and can hybridize detectably under high stringency conditions to transcript-derived nucleic acids that include the reference exon. The single exon probe will not, however, hybridize detectably under high stringency conditions to nucleic acids that lack the reference exon but include one or more exons that are found adjacent to the reference exon in the genome.

For purposes herein, "high stringency conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for at least 8 hours, followed by one or more washes in 0.2×SSC, 0.1% SDS at 65° C. "Moderate stringency conditions" are defined for solution phase hybridization as aqueous hybridization (i.e., free of formamide) in 6×SSC, 1% SDS at 65° C. for at least 8 hours, followed by one or more washes in 2×SSC, 0.1% SDS at room temperature.

For microarray-based hybridization, standard "high stringency conditions" are defined as hybridization in 50% formamide, 5×SSC, 0.2 $\mu g/\mu l$ poly(dA), 0.2 $\mu g/\mu l$ human cot1 DNA, and 0.5% SDS, in a humid oven at 42° C. overnight, followed by successive washes of the microarray in 1×SSC, 0.2% SDS at 55° C. for 5 minutes, and then 0.1×SSC, 0.2% SDS, at 55° C. for 20 minutes. For microarray-based hybridization, "moderate stringency conditions", suitable for cross-hybridization to mRNA encoding structurally- and functionally-related proteins, are defined to be the same as those for high stringency conditions but with reduction in temperature for hybridization and washing to room temperature (approximately 25° C.).

As used herein, the terms "protein", "polypeptide", and "peptide" are used interchangeably to refer to a naturally-occurring or synthetic polymer of amino acid monomers (residues), irrespective of length, where amino acid monomer here includes naturally-occurring amino acids, naturally-occurring amino acid structural variants, and synthetic non-naturally occurring analogs that are capable of participating in peptide bonds. The terms "protein", "polypeptide", and "peptide" explicitly permits of post-translational and post-synthetic modifications, such as glycosylation.

The term "oligopeptide" herein denotes a protein, polypeptide, or peptide having 25 or fewer monomeric subunits.

The phrases "isolated protein", "isolated polypeptide", "isolated peptide" and "isolated oligopeptidel" refer to a protein (or respectively to a polypeptide, peptide, or oligopeptide) that is nonidentical to any protein molecule of identical amino acid sequence as found in nature; "isolated" does not require, although it does not prohibit, that the protein so described has itself been physically removed from its native environment.

For example, a protein can be said to be "isolated" when it includes amino acid analogues or derivatives not found in nature, or includes linkages other than standard peptide bonds.

When instead composed entirely of natural amino acids linked by peptide bonds, a protein can be said to be "isolated" when it exists at a purity not found in nature—where purity can be adjudged with respect to the presence of proteins of other sequence, with respect to the presence of non-protein compounds, such as nucleic acids, lipids, or other components of a biological cell, or when it exists in a composition not found in nature, such as in a host cell that does not naturally express that protein.

A "purified protein" (equally, a purified polypeptide, peptide, or oligopeptide) is an isolated protein, as above described, present at a concentration of at least 95%, as measured on a mass basis with respect to total protein in a composition. A "substantially purified protein" (equally, a substantially purified polypeptide, peptide, or oligopeptide) is an isolated protein, as above described, present at a concentration of at least 70%, as measured on a mass basis with respect to total protein in a composition.

As used herein, the phrase "protein isoforms" refers to a plurality of proteins having nonidentical primary amino acid sequence but that share amino acid sequence encoded by at least one common exon.

As used herein, the phrase "alternative splicing" and its linguistic equivalents includes all types of RNA processing that lead to expression of plural protein isoforms from a single gene; accordingly, the phrase "splice variant(s)" and its linguistic equivalents embraces mRNAs transcribed from a given gene that, however processed, collectively encode plural protein isoforms. For example, and by way of illustration only, splice variants can include exon insertions, exon extensions, exon truncations, exon deletions, alternatives in the 5' untranslated region ("5' UT") and alternatives in the 3' untranslated region ("3' UT"). Such 31 alternatives include, for example, differences in the site of RNA transcript cleavage and site of poly(A) addition. See, e.g., Gautheret et al., Genome Res. 8:524–530 (1998).

As used herein, "orthologues" are separate occurrences of the same gene in multiple species. The separate occurrences have similar, albeit nonidentical, amino acid sequences, the degree of sequence similarity depending, in part, upon the evolutionary distance of the species from a common ancestor having the same gene.

As used herein, the term "paralogues" indicates separate occurrences of a gene in one species. The separate occurrences have similar, albeit nonidentical, amino acid sequences, the degree of sequence similarity depending, in part, upon the evolutionary distance from the gene duplication event giving rise to the separate occurrences.

As used herein, the term "homologues" is generic to "orthologues" and "paralogues".

As used herein, the term "antibody" refers to a polypeptide, at least a portion of which is encoded by at least one immunoglobulin gene, or fragment thereof, and that can bind specifically to a desired target molecule. The term includes naturally-occurring forms, as well as fragments and derivatives.

Fragments within the scope of the term "antibody" include those produced by digestion with various proteases, those produced by chemical cleavage and/or chemical dissociation, and those produced recombinantly, so long as the fragment remains capable of specific binding to a target molecule. Among such fragments are Fab, Fab', Fv, F(ab)'$_2$ and single chain Fv (scFv) fragments.

Derivatives within the scope of the term "antibody" include antibodies (or fragments thereof) that have been modified in sequence, but remain capable of specific binding to a target molecule, including: interspecies chimeric and humanized antibodies; antibody fusions; heteromeric antibody complexes and antibody fusions, such as diabodies (bispecific antibodies), single-chain diabodies, and intrabodies (see, e.g., Marasco (ed.), *Intracellular Antibodies: Research and Disease Applications*, Springer-Verlag New York, Inc. (1998) (ISBN: 3540641513), the disclosure of which is incorporated herein by reference in its entirety).

As used herein, "antigen" refers to a ligand that can be bound by an antibody; an antigen need not itself be immunogenic. The portions of the antigen that make contact with the antibody are denominated "epitopes".

"Specific binding" refers to the ability of two molecular species concurrently present in a heterogeneous (inhomogeneous) sample to bind to one another in preference to binding to other molecular species in the sample. Typically, a specific binding interaction will discriminate over adventitious binding interactions in the reaction by at least two-fold, more typically by at least 10-fold, often at least 100-fold; when used to detect analyte, specific binding is sufficiently discriminatory when determinative of the presence of the analyte in a heterogeneous (inhomogeneous) sample. Typically, the affinity or avidity of a specific binding reaction is least about $10^{-7}$ M, with specific binding reactions of greater specificity typically having affinity or avidity of at least $10^{-8}$ M to at least about $10^{-9}$ M.

As used herein, "molecular binding partners"—and equivalently, "specific binding partners"—refer to pairs of molecules, typically pairs of biomolecules, that exhibit specific binding. Nonlimiting examples are receptor and ligand, antibody and antigen, and biotin to any of avidin, streptavidin, neutrAvidin and captAvidin.

Unless made otherwise clear by context, "hGDMLP-1" as used herein includes both human hGDMLP-1 and orthologues from other species. Particularly useful orthologues are those from other primate species, such as chimpanzee, rhesus macaque monkey, baboon, orangutan, and gorilla; from rodents, such as rats, mice, guinea pigs; from lagomorphs, such as rabbits, and from domestic livestock, such as cow, pig, sheep, horse, goat.

The term "agonist", as used herein, refers to a molecule which, when bound to hGDMLP-1, increases or prolongs the duration of the effect of hGDMLP-1, or stimulates the function of hGDMLP-1. Conversely, an "antagonist", as used herein, refers to a molecule which, when bound to hGDMLP-1, decreases the amount or the duration of the effect of the biological or immunological activity of hGDMLP-1, or reduces the function of hGDMLP-1.

The term "antisense", as used herein, refers to a nucleic acid molecule sufficiently complementary in sequence and sufficiently long in complementary sequence as to hybridize under intracellular conditions to (i) a target mRNA transcript or (ii) the genomic DNA strand complementary to that transcribed to produce the target mRNA transcript.

A "biologically active" hGDMLP-1 protein, derivative, or fragment thereof has at least one measurable biological, biochemical, structural, or regulatory activity of hGDMLP-1. An "immunologically active" hGDMLP-1 protein, derivative, or fragment thereof is able to induce a specific cellular or humoral immune response to the immunizing protein, derivative, or fragment; although preferred, it is not required that the response be cross-reactive with native hGDMLP-1.

An agent is said to "modulate" the activity of hGDMLP-1 protein when it measurably changes at least one biological or immunological activity of hGDMLP-1; such change can, but need not, be effected by change in the amount of hGDMLP-1 present in a cell.

A "consensus sequence", as used herein, is a nucleic acid sequence that has been formulated by any or all of (i) resequencing to resolve uncalled bases, (ii) extension (e.g. by RACE or anchored PCR), or (iii) assembly from overlapping sequences of more than one clone.

The term "portion", as used with respect to nucleic acids, proteins, and antibodies, is synonymous with "fragment".

A "variant" of hGDMLP-1, as used herein, refers to a protein having a sequence that is altered from hGDMLP-1 by one or more amino acids. The term includes proteins having conservative or moderately conservative replacements, amino acid deletions, amino acid insertions, or combinations thereof. Guidance in determining which amino acid residues can be substituted, inserted, or deleted without abolishing biological or immunological activity is set forth herein below.

Nucleic Acid Molecules

In a first aspect, the invention provides isolated nucleic acids that encode hGDMLP-1, variants having at least 65% sequence identity thereto, degenerate variants thereof, variants that encode hGDMLP-1 proteins having conservative or moderately conservative substitutions, cross-hybridizing nucleic acids, and fragments thereof.

FIG. 2 presents the nucleotide sequence of the hGDMLP-1 cDNA clone, with predicted amino acid translation; the sequences are further presented in the Sequence Listing, incorporated herein by reference in its entirety, as follows:

| | |
|---|---|
| SEQ ID NO: 1 | (nt; full length cDNA) |
| SEQ ID NO: 2 | (nt; cDNA ORF) |
| SEQ ID NO: 3 | (aa; full length protein) |
| SEQ ID NO: 4 | (nt; cDNA nt 1–2953) |
| SEQ ID NO: 5 | (nt; cDNA nt 3175–end) |
| SEQ ID NOs: 6–2,942 | (nt; 17-mers scanning SEQ ID NO: 4) |
| SEQ ID NOs: 2,943–5,871 | (nt; 25-mers scanning SEQ ID NO: 4) |
| SEQ ID NOs: 5,872–10,771 | (nt; 17-mers scanning SEQ ID NO: 5) |
| SEQ ID NOs: 10,772–15,663 | (nt; 25-mers scanning SEQ ID NO: 5) |
| SEQ ID NOs: 15,664–15,707 | (nt; exons) |
| SEQ ID NOs: 15,708–15,751 | (nt; amplicons) |
| SEQ ID NO: 15,752 | (nt; putative promoter sequence) |

Unless otherwise indicated, each nucleotide sequence is set forth herein as a sequence of deoxyribonucleotides. It is intended, however, that the given sequence be interpreted as would be appropriate to the polynucleotide composition: for example, if the isolated nucleic acid is composed of RNA, the given sequence intends ribonucleotides, with uridine substituted for thymidine.

Unless otherwise indicated, nucleotide sequences of the isolated nucleic acids of the present invention were determined by sequencing a DNA molecule that had resulted, directly or indirectly, from at least one enzymatic polymerization reaction (e.g., reverse transcription and/or polymerase chain reaction) using an automated sequencer (such as the MegaBACE™ 1000, Molecular Dynamics, Sunnyvale, Calif., USA), or by reliance upon such sequence or upon genomic sequence prior-accessioned into a public database. Unless otherwise indicated, all amino acid sequences of the polypeptides of the present invention were predicted by translation from the nucleic acid sequences so determined.

As a consequence, any nucleic acid sequence presented herein may contain errors introduced by erroneous incorporation of nucleotides during polymerization, by erroneous base calling by the automated sequencer (although such sequencing errors have been minimized for the nucleic acids directly determined herein, unless otherwise indicated, by the sequencing of each of the complementary strands of a duplex DNA), or by similar errors accessioned into the public database.

Accordingly, the hGDMLP-1 cDNA clone described herein has been deposited in a public repository (American Type Culture Collection, Manassas, Va., USA). The deposit, made according to the Budapest Treat on the International Recognition of the Deposit of Microorganisms for the Purposes of Patent Procedure, was received at ATCC on May 23, 2001 and given an accession number of PTA-3397. Any errors in sequence reported herein can be determined and corrected by sequencing nucleic acids propagated from the deposited clones using standard techniques.

Single nucleotide polymorphisms (SNPs) occur frequently in eukaryotic genomes—more than 1.4 million SNPs have already identified in the human genome, International Human Genome Sequencing Consortium, *Nature* 409:860–921 (2001)—and the sequence determined from one individual of a species may differ from other allelic forms present within the population. Additionally, small deletions and insertions, rather than single nucleotide polymorphisms, are not uncommon in the general population, and often do not alter the function of the protein.

Accordingly, it is an aspect of the present invention to provide nucleic acids not only identical in sequence to those described with particularity herein, but also to provide isolated nucleic acids at least about 65% identical in sequence to those described with particularity herein, typically at least about 70%, 75%, 80%, 85%, or 90% identical in sequence to those described with particularity herein, usefully at least about 91%, 92%, 93%, 94%, or 95% identical in sequence to those described with particularity herein, usefully at least about 96%, 97%, 98%, or 99% identical in sequence to those described with particularity herein, and, most conservatively, at least about 99.5%, 99.6%, 99.7%, 99.8% and 99.9% identical in sequence to those described with particularity herein. These sequence variants can be naturally occurring or can result from human intervention, as by random or directed mutagenesis.

For purposes herein, percent identity of two nucleic acid sequences is determined using the procedure of Tatiana et al., "Blast 2 sequences—a new tool for comparing protein and nucleotide sequences", FEMS Microbiol Lett. 174:247–250(1999), which procedure is effectuated by the computer program BLAST 2 SEQUENCES, available online at the National Center for Biotechnology Information (NCBI) website. To assess percent identity of nucleic acids, the BLASTN module of BLAST 2 SEQUENCES is used with default values of (i) reward for a match: 1; (ii) penalty for a mismatch: −2; (iii) open gap 5 and extension gap 2 penalties; (iv) gap X_dropoff 50 expect 10 word size 11 filter, and both sequences are entered in their entireties.

As is well known, the genetic code is degenerate, with each amino acid except methionine translated from a plurality of codons, thus permitting a plurality of nucleic acids of disparate sequence to encode the identical protein. As is also well known, codon choice for optimal expression varies from species to species. The isolated nucleic acids of the present invention being useful for expression of hGDMLP-1 proteins and protein fragments, it is, therefore, another aspect of the present invention to provide isolated nucleic acids that encode hGDMLP-1 proteins and portions thereof not only identical in sequence to those described with particularity herein, but degenerate variants thereof as well.

As is also well known, amino acid substitutions occur frequently among natural allelic variants, with conservative substitutions often occasioning only de minimis change in protein function.

Accordingly, it is an aspect of the present invention to provide nucleic acids not only identical in sequence to those described with particularity herein, but also to provide isolated nucleic acids that encode hGDMLP-1, and portions thereof, having conservative amino acid substitutions, and also to provide isolated nucleic acids that encode hGDMLP-1, and portions thereof, having moderately conservative amino acid substitutions.

Although there are a variety of metrics for calling conservative amino acid substitutions, based primarily on either observed changes among evolutionarily related proteins or on predicted chemical similarity, for purposes herein a conservative replacement is any change having a positive value in the PAM250 log-likelihood matrix reproduced herein below (see Gonnet et al., *Science* 256(5062):1443–5 (1992)):

|   | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 2 | −1 | 0 | 0 | 0 | 0 | 0 | 0 | −1 | −1 | −1 | 0 | −1 | −2 | 0 | 1 | 1 | −4 | −2 | 0 |
| R | −1 | 5 | 0 | 0 | −2 | 2 | 0 | −1 | 1 | −2 | −2 | 3 | −2 | −3 | −1 | 0 | 0 | −2 | −2 | −2 |
| N | 0 | 0 | 4 | 2 | −2 | 1 | 1 | 0 | 1 | −3 | −3 | 1 | −2 | −3 | −1 | 1 | 0 | −4 | −1 | −2 |
| D | 0 | 0 | 2 | 5 | −3 | 1 | 3 | 0 | 0 | −4 | −4 | 0 | −3 | −4 | −1 | 0 | 0 | −5 | −3 | −3 |
| C | 0 | −2 | −2 | −3 | 12 | −2 | −3 | −2 | −1 | −1 | −2 | −3 | −1 | −1 | −3 | 0 | 0 | −1 | 0 | 0 |
| Q | 0 | 2 | 1 | 1 | −2 | 3 | 2 | −1 | 1 | −2 | −2 | 2 | −1 | −3 | 0 | 0 | 0 | −3 | −2 | −2 |
| E | 0 | 0 | 1 | 3 | −3 | 2 | 4 | −1 | 0 | −3 | −3 | 1 | −2 | −4 | 0 | 0 | 0 | −4 | −3 | −2 |
| G | 0 | −1 | 0 | 0 | −2 | −1 | −1 | 7 | −1 | −4 | −4 | −1 | −4 | −5 | −2 | 0 | −1 | −4 | −4 | −3 |
| H | −1 | 1 | 1 | 0 | −1 | 1 | 0 | −1 | 6 | −2 | −2 | 1 | −1 | 0 | −1 | 0 | 0 | −1 | 2 | −2 |
| I | −1 | −2 | −3 | −4 | −1 | −2 | −3 | −4 | −2 | 4 | 3 | −2 | 2 | 1 | −3 | −2 | −1 | −2 | −1 | 3 |
| L | −1 | −2 | −3 | −4 | −2 | −2 | −3 | −4 | −2 | 3 | 4 | −2 | 3 | 2 | −2 | −2 | −1 | −1 | 0 | 2 |

-continued

|   | A  | R  | N  | D  | C  | Q  | E  | G  | H  | I  | L  | K  | M  | F  | P  | S  | T  | W  | Y  | V  |
|---|----|----|----|----|----|----|----|----|----|----|----|----|----|----|----|----|----|----|----|----|
| K | 0  | 3  | 1  | 0  | -3 | 2  | 1  | -1 | 1  | -2 | -2 | 3  | -1 | -3 | -1 | 0  | 0  | -4 | -2 | -2 |
| M | -1 | -2 | -2 | -3 | -1 | -1 | -2 | -4 | -1 | 2  | 3  | -1 | 4  | 2  | -2 | -1 | -1 | -1 | 0  | 2  |
| F | -2 | -3 | -3 | -4 | -1 | -3 | -4 | -5 | 0  | 1  | 2  | -3 | 2  | 7  | -4 | -3 | -2 | 4  | 5  | 0  |
| P | 0  | -1 | -1 | -1 | -3 | 0  | 0  | -2 | -1 | -3 | -2 | -1 | -2 | -4 | 8  | 0  | 0  | -5 | -3 | -2 |
| S | 1  | 0  | 1  | 0  | 0  | 0  | 0  | 0  | 0  | -2 | -2 | 0  | -1 | -3 | 0  | 2  | 2  | -3 | -2 | -1 |
| T | 1  | 0  | 0  | 0  | 0  | 0  | 0  | -1 | 0  | -1 | -1 | 0  | -1 | -2 | 0  | 2  | 2  | -4 | -2 | 0  |
| W | -4 | -2 | -4 | -5 | -1 | -3 | -4 | -4 | -1 | -2 | -1 | -4 | -1 | 4  | -5 | -3 | -4 | 14 | 4  | -3 |
| Y | -2 | -2 | -1 | -3 | 0  | -2 | -3 | -4 | 2  | -1 | 0  | -2 | 0  | 5  | -3 | -2 | -2 | 4  | 8  | -1 |
| V | 0  | -2 | -2 | -3 | 0  | -2 | -2 | -3 | -2 | 3  | 2  | -2 | 2  | 0  | -2 | -1 | 0  | -3 | -1 | 3  |

For purposes herein, a "moderately conservative" replacement is any change having a nonnegative value in the PAM250 log-likelihood matrix reproduced herein above.

As is also well known in the art, relatedness of nucleic acids can also be characterized using a functional test, the ability of the two nucleic acids to base-pair to one another at defined hybridization stringencies.

It is, therefore, another aspect of the invention to provide isolated nucleic acids not only identical in sequence to those described with particularity herein, but also to provide isolated nucleic acids ("cross-hybridizing nucleic acids") that hybridize under high stringency conditions (as defined herein) to all or to a portion of various of the isolated hGDMLP-1 nucleic acids of the present invention ("reference nucleic acids"), as well as cross-hybridizing nucleic acids that hybridize under moderate stringency conditions to all or to a portion of various of the isolated hGDMLP-1 nucleic acids of the present invention.

Such cross-hybridizing nucleic acids are useful, inter alia, as probes for, and to drive expression of, proteins related to the proteins of the present invention as alternative isoforms, homologues, paralogues, and orthologues. Particularly preferred orthologues are those from other primate species, such as chimpanzee, rhesus macaque, baboon, and gorilla, from rodents, such as rats, mice, guinea pigs, and from livestock, such as cow, pig, sheep, horse, goat.

The hybridizing portion of the reference nucleic acid is typically at least 15 nucleotides in length, often at least 17 nucleotides in length. Often, however, the hybridizing portion of the reference nucleic acid is at least 20 nucleotides in length, 25 nucleotides in length, and even 30 nucleotides, 35 nucleotides, 40 nucleotides, and 50 nucleotides in length. Of course, cross-hybridizing nucleic acids that hybridize to a larger portion of the reference nucleic acid—for example, to a portion of at least 50 nt, at least 100 nt, at least 150 nt, 200 nt, 250 nt, 300 nt, 350 nt, 400 nt, 450 nt, or 500 nt or more—or even to the entire length of the reference nucleic acid, are also useful.

The hybridizing portion of the cross-hybridizing nucleic acid is at least 75% identical in sequence to at least a portion of the reference nucleic acid. Typically, the hybridizing portion of the cross-hybridizing nucleic acid is at least 80%, often at least 85%, 86%, 87%, 88%, 89% or even at least 90% identical in sequence to at least a portion of the reference nucleic acid. Often, the hybridizing portion of the cross-hybridizing nucleic acid will be at least 91%, 92%, 93%, 94%, 95%, 96%, 97%, 98%, or 99% identical in sequence to at least a portion of the reference nucleic acid sequence. At times, the hybridizing portion of the cross-hybridizing nucleic acid will be at least 99.5% identical in sequence to at least a portion of the reference nucleic acid.

The invention also provides fragments of various of the isolated nucleic acids of the present invention.

By "fragments" of a reference nucleic acid is here intended isolated nucleic acids, however obtained, that have a nucleotide sequence identical to a portion of the reference nucleic acid sequence, which portion is at least 17 nucleotides and less than the entirety of the reference nucleic acid. As so defined, "fragments" need not be obtained by physical fragmentation of the reference nucleic acid, although such provenance is not thereby precluded.

In theory, an oligonucleotide of 17 nucleotides is of sufficient length as to occur at random less frequently than once in the three gigabase human genome, and thus to provide a nucleic acid probe that can uniquely identify the reference sequence in a nucleic acid mixture of genomic complexity. As is well known, further specificity can be obtained by probing nucleic acid samples of subgenomic complexity, and/or by using plural fragments as short as 17 nucleotides in length collectively to prime amplification of nucleic acids, as, e.g., by polymerase chain reaction (PCR).

As further described herein below, nucleic acid fragments that encode at least 6 contiguous amino acids (i.e., fragments of 18 nucleotides or more) are useful in directing the expression or the synthesis of peptides that have utility in mapping the epitopes of the protein encoded by the reference nucleic acid. See, e.g., Geysen et al., "Use of peptide synthesis to probe viral antigens for epitopes to a resolution of a single amino acid," *Proc. Natl. Acad. Sci. USA* 81:3998–4002 (1984); and U.S. Pat. Nos. 4,708,871 and 5,595,915, the disclosures of which are incorporated herein by reference in their entireties.

As further described herein below, fragments that encode at least 8 contiguous amino acids (i.e., fragments of 24 nucleotides or more) are useful in directing the expression or the synthesis of peptides that have utility as immunogens. See, e.g., Lerner, "Tapping the immunological repertoire to produce antibodies of predetermined specificity," Nature 299:592–596 (1982); Shinnick et al., "Synthetic peptide immunogens as vaccines," *Annu. Rev. Microbiol.* 37:425–46 (1983); Sutcliffe et al., "Antibodies that react with predetermined sites on proteins," Science 219:660–6 (1983), the disclosures of which are incorporated herein by reference in their entireties.

The nucleic acid fragment of the present invention is thus at least 17 nucleotides in length, typically at least 18 nucleotides in length, and often at least 24 nucleotides in length. Often, the nucleic acid of the present invention is at least 25 nucleotides in length, and even 30 nucleotides, 35 nucleotides, 40 nucleotides, or 45 nucleotides in length. Of course, larger fragments having at least 50 nt, at least 100 nt, at least 150 nt, 200 nt, 250 nt, 300 nt, 350 nt, 400 nt, 450 nt, or 500 nt or more are also useful, and at times preferred.

Having been based upon the mining of genomic sequence, rather than upon surveillance of expressed message, the present invention further provides isolated genome-derived nucleic acids that include portions of the hGDMLP-1 gene.

The invention particularly provides genome-derived single exon probes.

As further described in commonly owned and copending U.S. patent application Ser. No. 09/774,203, filed Jan. 29, 2001 and Ser. No. 09/632,366, filed Aug. 3, 2000, and provisional U.S. patent application No. 60/236,359, filed May 26, 2000 and No. 60/236,359, filed Sep. 27, 2000, the disclosures of which are incorporated herein by reference in their entireties, "a single exon probe" comprises at least part of an exon ("reference exon") and can hybridize detectably under high stringency conditions to transcript-derived nucleic acids that include the reference exon. The single exon probe will not, however, hybridize detectably under high stringency conditions to nucleic acids that lack the reference exon but include one or more exons that are found adjacent to the reference exon in the genome.

Genome-derived single exon probes typically further comprise, contiguous to a first end of the reference exon portion, a first intronic and/or intergenic sequence that is identically contiguous to the exon in the genome. Often, the genome-derived single exon probe further comprises, contiguous to a second end of the exonic portion, a second intronic and/or intergenic sequence that is identically contiguous to the exon in the genome.

The minimum length of genome-derived single exon probes is defined by the requirement that the exonic portion be of sufficient length to hybridize under high stringency conditions to transcript-derived nucleic acids. Accordingly, the exon portion is at least 17 nucleotides, typically at least 18 nucleotides, 20 nucleotides, 24 nucleotides, 25 nucleotides or even 30, 35, 40, 45, or 50 nucleotides in length, and can usefully include the entirety of the exon, up to 100 nt, 150 nt, 200 nt, 250 nt, 300 nt, 350 nt, 400 nt or even 500 nt or more in length.

The maximum length of genome-derived single exon probes is defined by the requirement that the probes contain portions of no more than one exon, that is, be unable to hybridize detectably under high stringency conditions to nucleic acids that lack the reference exon but include one or more exons that are found adjacent to the reference exon in the genome.

Given variable spacing of exons through eukaryotic genomes, the maximum length of the single exon probes of the present invention is typically no more than 25 kb, often no more than 20 kb, 15 kb, 10 kb or 7.5 kb, or even no more than 5 kb, 4 kb, 3 kb, or even no more than about 2.5 kb in length.

The genome-derived single exon probes of the present invention can usefully include at least a first terminal priming sequence not found in contiguity with the rest of the probe sequence in the genome, and often will contain a second terminal priming sequence not found in contiguity with the rest of the probe sequence in the genome.

The present invention also provides isolated genome-derived nucleic acids that include nucleic acid sequence elements that control transcription of the hGDMLP-1 gene.

With a complete draft of the human genome now available, genomic sequences that are within the vicinity of the hGDMLP-1 gene (and that are additional to those described with particularity herein) can readily be obtained by PCR amplification.

The isolated nucleic acids of the present invention can be composed of natural nucleotides in native 5'-3' phosphodiester internucleoside linkage—e.g., DNA or RNA—or can contain any or all of nonnatural nucleotide analogues, non-native internucleoside bonds, or post-synthesis modifications, either throughout the length of the nucleic acid or localized to one or more portions thereof. As is well known in the art, when the isolated nucleic acid is used as a hybridization probe, the range of such nonnatural analogues, nonnative internucleoside bonds, or post-synthesis modifications will be limited to those that permit sequence-discriminating basepairing of the resulting nucleic acid. When used to direct expression or RNA or protein in vitro or in vivo, the range of such nonnatural analogues, nonnative internucleoside bonds, or post-synthesis modifications will be limited to those that permit the nucleic acid to function properly as a polymerization substrate. When the isolated nucleic acid is used as a therapeutic agent, the range of such changes will be limited to those that do not confer toxicity upon the isolated nucleic acid.

For example, when desired to be used as probes, the isolated nucleic acids of the present invention can usefully include nucleotide analogues that incorporate labels that are directly detectable, such as radiolabels or fluorophores, or nucleotide analogues that incorporate labels that can be visualized in a subsequent reaction, such as biotin or various haptens.

Common radiolabeled analogues include those labeled with $^{33}$P, $^{32}$P, and $^{35}$S, such as $\alpha$-$^{32}$P-dATP, $\alpha$-$^{32}$P-dCTP, $\alpha$-$^{32}$P-dGTP, $\alpha$-$^{32}$P-dTTP, $\alpha$-$^{32}$P-3'dATP, $\alpha$-$^{32}$P-ATP, $\alpha$-$^{32}$P-CTP, $\alpha$-$^{32}$P-GTP, $\alpha$-$^{32}$P-UTP, $\alpha$-$^{35}$S-DATP, $\gamma$-$^{35}$S-GTP, $\gamma$-$^{33}$P-dATP, and the like.

Commercially available fluorescent nucleotide analogues readily incorporated into the nucleic acids of the present invention include Cy3-dCTP, Cy3-dUTP, Cy5-dCTP, Cy3-dUTP (Amersham Pharmacia Biotech, Piscataway, N.J., USA), fluorescein-12-dUTP, tetramethylrhodamine-6-dUTP, Texas Red®-5-dUTP, Cascade Blue®-7-dUTP, BODIPY® FL-14-dUTP, BODIPY® TMR-14-dUTP, BODIPY® TR-14-dUTP, Rhodamine Green™-5-dUTP, Oregon Green® 488-5-dUTP, Texas Red®-12-dUTP, BODIPYO 630/650-14-dUTP, BODIPY® 650/665-14-dUTP, Alexa Fluor® 488-5-dUTP, Alexa Fluor® 532-5-dUTP, Alexa Fluor® 568-5-dUTP, Alexa Fluor® 594-5-dUTP, Alexa Fluor® 546-14-dUTP, fluorescein-12-UTP, tetramethylrhodamine-6-UTP, Texas Red®-5-UTP, Cascade Blue®-7-UTP, BODIPY® FL-14-UTP, BODIPYO TMR-14-UTP, BODIPY® TR-14-UTP, Rhodamine Green™-5-UTP, Alexa Fluor® 488-5-UTP, Alexa Fluor® 546-14-UTP (Molecular Probes, Inc. Eugene, Oreg., USA).

Protocols are available for custom synthesis of nucleotides having other fluorophores. Henegariu et al., "Custom Fluorescent-Nucleotide Synthesis as an Alternative Method for Nucleic Acid Labeling," *Nature Biotechnol.* 18:345-348 (2000), the disclosure of which is incorporated herein by reference in its entirety.

Haptens that are commonly conjugated to nucleotides for subsequent labeling include biotin (biotin-11-dUTP, Molecular Probes, Inc., Eugene, Oreg., USA; biotin-21-UTP, biotin-21-dUTP, Clontech Laboratories, Inc., Palo Alto, Calif., USA), digoxigenin (DIG-11-dUTP, alkali labile, DIG-11-UTP, Roche Diagnostics Corp., Indianapolis, Ind., USA), and dinitrophenyl (dinitrophenyl-11-dUTP, Molecular Probes, Inc., Eugene, Oreg., USA).

As another example, when desired to be used for antisense inhibition of transcription or translation, the isolated nucleic acids of the present invention can usefully include altered, often nuclease-resistant, internucleoside bonds. See Hartmann et al. (eds.), *Manual of Antisense Methodology* (Perspectives in Antisense Science), Kluwer Law International (1999) (ISBN:079238539X); Stein et al. (eds.), *Applied Antisense Oligonucleotide Technology*, Wiley-Liss (cover (1998) (ISBN: 0471172790); Chadwick et al. (eds.), *Oligonucleotides as Therapeutic Agents—Symposium No. 209*, John Wiley & Son Ltd (1997) (ISBN: 0471972797), the disclosures of which are incorporated herein by reference in their entireties. Such altered internucloside bonds are often desired also when the isolated nucleic acid of the present invention is to be used for targeted gene correction, Gamper et al., *Nucl. Acids Res.* 28(21):4332–9 (2000), the disclosure of which is incorporated herein by reference in its entirety.

Modified oligonucleotide backbones often preferred when the nucleic acid is to be used for antisense purposes are, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'–5' linkages, 2'–5' linked analogs of these, and those having inverted polarity wherein the adjacent pairs of nucleoside units are linked 3'–5' to 5'–3' or 2'–5' to 5'–2'. Representative U.S. patents that teach the preparation of the above phosphorus-containing linkages include, but are not limited to, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, the disclosures of which are incorporated herein by reference in their entireties.

Preferred modified oligonucleotide backbones for antisense use that do not include a phosphorus atom have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Representative U.S. patents that teach the preparation of the above backbones include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, the disclosures of which are incorporated herein by reference in their entireties.

In other preferred oligonucleotide mimetics, both the sugar and the internucleoside linkage are replaced with novel groups, such as peptide nucleic acids (PNA).

In PNA compounds, the phosphodiester backbone of the nucleic acid is replaced with an amide-containing backbone, in particular by repeating N-(2-aminoethyl) glycine units linked by amide bonds. Nucleobases are bound directly or indirectly to aza nitrogen atoms of the amide portion of the backbone, typically by methylene carbonyl linkages.

The uncharged nature of the PNA backbone provides PNA/DNA and PNA/RNA duplexes with a higher thermal stability than is found in DNA/DNA and DNA/RNA duplexes, resulting from the lack of charge repulsion between the PNA and DNA or RNA strand. In general, the Tm of a PNA/DNA or PNA/RNA duplex is 1° C. higher per base pair than the Tm of the corresponding DNA/DNA or DNA/RNA duplex (in 100 mM NaCl).

The neutral backbone also allows PNA to form stable DNA duplexes largely independent of salt concentration. At low ionic strength, PNA can be hybridized to a target sequence at temperatures that make DNA hybridization problematic or impossible. And unlike DNA/DNA duplex formation, PNA hybridization is possible in the absence of magnesium. Adjusting the ionic strength, therefore, is useful if competing DNA or RNA is present in the sample, or if the nucleic acid being probed contains a high level of secondary structure.

PNA also demonstrates greater specificity in binding to complementary DNA. A PNA/DNA mismatch is more destabilizing than DNA/DNA mismatch. A single mismatch in mixed a PNA/DNA 15-mer lowers the Tm by 8–20° C. (15° C. on average). In the corresponding DNA/DNA duplexes, a single mismatch lowers the Tm by 4–16° C. (11° C. on average). Because PNA probes can be significantly shorter than DNA probes, their specificity is greater.

Additionally, nucleases and proteases do not recognize the PNA polyamide backbone with nucleobase sidechains. As a result, PNA oligomers are resistant to degradation by enzymes, and the lifetime of these compounds is extended both in vivo and in vitro. In addition, PNA is stable over a wide pH range.

Because its backbone is formed from amide bonds, PNA can be synthesized using a modified peptide synthesis protocol. PNA oligomers can be synthesized by both Fmoc and tBoc methods. Representative U.S. patents that teach the preparation of PNA compounds include, but are not limited to, U.S. Pat. Nos. 5,539,082; 5,714,331; and 5,719,262, each of which is herein incorporated by reference; automated PNA synthesis is readily achievable on commercial synthesizers (see, e.g., "PNA User's Guide," Rev. 2, February 1998, Perseptive Biosystems Part No. 60138, Applied Biosystems, Inc., Foster City, Calif.).

PNA chemistry and applications are reviewed, inter alia, in Ray et al., *FASEB J.* 14(9):1041–60 (2000); Nielsen et al., *Pharmacol Toxicol.* 86(1):3–7 (2000); Larsen et al., *Biochim Biophys Acta.* 1489(1):159–66 (1999); Nielsen, *Curr. Opin. Struct. Biol.* 9(3):353–7 (1999), and Nielsen, *Curr. Opin. Biotechnol.* 10(1):71–5 (1999), the disclosures of which are incorporated herein by reference in their entireties.

Differences from nucleic acid compositions found in nature—e.g., nonnative bases, altered internucleoside linkages, post-synthesis modification—can be present throughout the length of the nucleic acid or can, instead, usefully be localized to discrete portions thereof. As an example of the latter, chimeric nucleic acids can be synthesized that have discrete DNA and RNA domains and demonstrated utility for targeted gene repair, as further described in U.S. Pat. Nos. 5,760,012 and 5,731,181, the disclosures of which are incorporated herein by reference in their entireties. As another example, chimeric nucleic acids comprising both DNA and PNA have been demonstrated to have utility in modified PCR reactions. See Misra et al., *Biochem.* 37: 1917–1925 (1998); see also Finn et al., *Nucl. Acids Res.* 24: 3357–3363 (1996), incorporated herein by reference.

Unless otherwise specified, nucleic acids of the present invention can include any topological conformation appropriate to the desired use; the term thus explicitly comprehends, among others, single-stranded, double-stranded, triplexed, quadruplexed, partially double-stranded, partially-triplexed, partially-quadruplexed, branched, hairpinned, circular, and padlocked conformations. Padlock conformations and their utilities are further described in Banèr et al., *Curr. Opin. Biotechnol.* 12:11–15 (2001); Escude et al., Proc. Natl. Acad. Sci. USA 14;96(19):10603–7 (1999); Nilsson et al., *Science* 265(5181):2085–8 (1994), the disclosures of which are incorporated herein by reference in their entireties. Triplex and quadruplex conformations, and their utilities, are reviewed in Praseuth et al., *Biochim. Biophys. Acta.* 1489(1):181–206 (1999); Fox, *Curr. Med. Chem.* 7(1):17–37 (2000); Kochetkova et al., *Methods Mol. Biol.* 130:189–201 (2000); Chan et al., *J. Mol. Med.* 75(4): 267–82 (1997), the disclosures of which are incorporated herein by reference in their entireties.

The nucleic acids of the present invention can be detectably labeled.

Commonly-used labels include radionuclides, such as $^{32}$P, $^{33}$P, $^{35}$S, $^{3}$H (and for NMR detection, $^{13}$C and $^{15}$N), haptens that can be detected by specific antibody or high affinity binding partner (such as avidin), and fluorophores.

As noted above, detectable labels can be incorporated by inclusion of labeled nucleotide analogues in the nucleic acid. Such analogues can be incorporated by enzymatic polymerization, such as by nick translation, random priming, polymerase chain reaction (PCR), terminal transferase tailing, and end-filling of overhangs, for DNA molecules, and in vitro transcription driven, e.g., from phage promoters, such as T7, T3, and SP6, for RNA molecules. Commercial kits are readily available for each such labeling approach.

Analogues can also be incorporated during automated solid phase chemical synthesis.

As is well known, labels can also be incorporated after nucleic acid synthesis, with the 5' phosphate and 3' hydroxyl providing convenient sites for post-synthetic covalent attachment of detectable labels.

Various other post-synthetic approaches permit internal labeling of nucleic acids.

For example, fluorophores can be attached using a cisplatin reagent that reacts with the N7 of guanine residues (and, to a lesser extent, adenine bases) in DNA, RNA, and PNA to provide a stable coordination complex between the nucleic acid and fluorophore label (Universal Linkage System) (available from Molecular Probes, Inc., Eugene, Oreg., USA and Amersham Pharmacia Biotech, Piscataway, N.J., USA); see Alers et al., *Genes, Chromosomes & Cancer*, Vol. 25, pp. 301–305 (1999); Jelsma et al., *J. NIH Res.* 5:82 (1994); Van Belkum et al., *BioTechniques* 16:148–153 (1994), incorporated herein by reference. As another example, nucleic acids can be labeled using a disulfide-containing linker (FastTag™ Reagent, Vector Laboratories, Inc., Burlingame, Calif., USA) that is photo- or thermally coupled to the target nucleic acid using aryl azide chemistry; after reduction, a free thiol is available for coupling to a hapten, fluorophore, sugar, affinity ligand, or other marker.

Multiple independent or interacting labels can be incorporated into the nucleic acids of the present invention.

For example, both a fluorophore and a moiety that in proximity thereto acts to quench fluorescence can be included to report specific hybridization through release of fluorescence quenching, Tyagi et al., *Nature Biotechnol.* 14: 303–308 (1996); Tyagi et al., *Nature Biotechnol.* 16, 49–53 (1998); Sokol et al., *Proc. Natl. Acad. Sci. USA* 95: 11538–11543 (1998); Kostrikis et al., *Science* 279:1228–1229 (1998); Marras et al., *Genet. Anal.* 14: 151–156 (1999); U.S. Pat. Nos. 5,846,726, 5,925,517, 5,925,517, or to report exonucleotidic excision, U.S. Pat. No. 5,538,848; Holland et al., *Proc. Natl. Acad. Sci. USA* 88:7276–7280 (1991); Heid et al., *Genome Res.* 6(10): 986–94 (1996); Kuimelis et al., *Nucleic Acids Symp* Ser. (37):255–6 (1997); U.S. Pat. No. 5,723,591, the disclosures of which are incorporated herein by reference in their entireties.

So labeled, the isolated nucleic acids of the present invention can be used as probes, as further described below.

Nucleic acids of the present invention can also usefully be bound to a substrate. The substrate can porous or solid, planar or non-planar, unitary or distributed; the bond can be covalent or noncovalent. Bound to a substrate, nucleic acids of the present invention can be used as probes in their unlabeled state.

For example, the nucleic acids of the present invention can usefully be bound to a porous substrate, commonly a membrane, typically comprising nitrocellulose, nylon, or positively-charged derivatized nylon; so attached, the nucleic acids of the present invention can be used to detect hGDMLP-1 nucleic acids present within a labeled nucleic acid sample, either a sample of genomic nucleic acids or a sample of transcript-derived nucleic acids, e.g. by reverse dot blot.

The nucleic acids of the present invention can also usefully be bound to a solid substrate, such as glass, although other solid materials, such as amorphous silicon, crystalline silicon, or plastics, can also be used. Such plastics include polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof.

Typically, the solid substrate will be rectangular, although other shapes, particularly disks and even spheres, present certain advantages. Particularly advantageous alternatives to glass slides as support substrates for array of nucleic acids are optical discs, as described in Demers, "Spatially Addressable Combinatorial Chemical Arrays in CD-ROM Format," international patent publication WO 98/12559, incorporated herein by reference in its entirety.

The nucleic acids of the present invention can be attached covalently to a surface of the support substrate or applied to a derivatized surface in a chaotropic agent that facilitates denaturation and adherence by presumed noncovalent interactions, or some combination thereof.

The nucleic acids of the present invention can be bound to a substrate to which a plurality of other nucleic acids are concurrently bound, hybridization to each of the plurality of bound nucleic acids being separately detectable. At low density, e.g. on a porous membrane, these substrate-bound collections are typically denominated macroarrays; at higher density, typically on a solid support, such as glass, these substrate bound collections of plural nucleic acids are colloquially termed microarrays. As used herein, the term microarray includes arrays of all densities. It is, therefore, another aspect of the invention to provide microarrays that include the nucleic acids of the present invention.

The isolated nucleic acids of the present invention can be used as hybridization probes to detect, characterize, and quantify hGDMLP-1 nucleic acids in, and isolate hGDMLP-1 nucleic acids from, both genomic and transcript-derived nucleic acid samples. When free in solution, such probes are typically, but not invariably, detectably labeled; bound to a substrate, as in a microarray, such probes are typically, but not invariably, unlabeled.

For example, the isolated nucleic acids of the present invention can be used as probes to detect and characterize gross alterations in the hGDMLP-1 genomic locus, such as deletions, insertions, translocations, and duplications of the hGDMLP-1 genomic locus through fluorescence in situ hybridization (FISH) to chromosome spreads. See, e.g., Andreeff et al. (eds.), *Introduction to Fluorescence In Situ Hybridization: Principles and Clinical Applications*, John Wiley & Sons (1999) (ISBN: 0471013455), the disclosure of which is incorporated herein by reference in its entirety. The isolated nucleic acids of the present invention can be used as probes to assess smaller genomic alterations using, e.g., Southern blot detection of restriction fragment length polymorphisms. The isolated nucleic acids of the present invention can be used as probes to isolate genomic clones that include the nucleic acids of the present invention, which thereafter can be restriction mapped and sequenced to identify deletions, insertions, translocations, and substitutions (single nucleotide polymorphisms, SNPs) at the sequence level.

The isolated nucleic acids of the present invention can be also be used as probes to detect, characterize, and quantify hGDMLP-1 nucleic acids in, and isolate hGDMLP-1 nucleic acids from, transcript-derived nucleic acid samples.

For example, the isolated nucleic acids of the present invention can be used as hybridization probes to detect, characterize by length, and quantify hGDMLP-1 mRNA by northern blot of total or poly-A+−selected RNA samples. For example, the isolated nucleic acids of the present invention can be used as hybridization probes to detect, characterize by location, and quantify hGDMLP-1 message by in situ hybridization to tissue sections (see, e.g., Schwarchzacher et al., *In Situ Hybridization*, Springer-Verlag New York (2000) (ISBN: 0387915966), the disclosure of which is incorporated herein by reference in its entirety). For example, the isolated nucleic acids of the present invention can be used as hybridization probes to measure the representation of hGDMLP-1 clones in a cDNA library. For example, the isolated nucleic acids of the present invention can be used as hybridization probes to isolate hGDMLP-1 nucleic acids from cDNA libraries, permitting sequence level characterization of hGDMLP-1 messages, including identification of deletions, insertions, truncations—including deletions, insertions, and truncations of exons in alternatively spliced forms—and single nucleotide polymorphisms.

All of the aforementioned probe techniques are well within the skill in the art, and are described at greater length in standard texts such as Sambrook et al., *Molecular Cloning: A Laboratory Manual* (3rd ed.), Cold Spring Harbor Laboratory Press (2001) (ISBN: 0879695773); Ausubel et al. (eds.), *Short Protocols in Molecular Biology: A Compendium of Methods from Current Protocols in Molecular Biology* (4th ed.), John Wiley & Sons, 1999 (ISBN: 047132938X); and Walker et al. (eds.), *The Nucleic Acids Protocols Handbook*, Humana Press (2000) (ISBN: 0896034593), the disclosures of which are incorporated herein by reference in their entirety.

As described in the Examples herein below, the nucleic acids of the present invention can also be used to detect and quantify hGDMLP-1 nucleic acids in transcript-derived samples—that is, to measure expression of the hGDMLP-1 gene—when included in a microarray. Measurement of hGDMLP-1 expression has particular utility in diagnosis of genetic disorders of the hGDMLP-1 gene.

As would be readily apparent to one of skill in the art, each hGDMLP-1 nucleic acid probe—whether labeled, substrate-bound, or both—is thus currently available for use as a tool for measuring the level of hGDMLP-1 expression in each of the tissues in which expression has already been confirmed, notably in heart and skeletal muscle. The utility is specific to the probe: under high stringency conditions, the probe reports the level of expression of message specifically containing that portion of the hGDMLP-1 gene included within the probe.

Measuring tools are well known in many arts, not just in molecular biology, and are known to possess credible, specific, and substantial utility. For example, U.S. Pat. No. 6,016,191 describes and claims a tool for measuring characteristics of fluid flow in a hydrocarbon well; U.S. Pat. No. 6,042,549 describes and claims a device for measuring exercise intensity; U.S. Pat. No. 5,889,351 describes and claims a device for measuring viscosity and for measuring characteristics of a fluid; U.S. Pat. No. 5,570,694 describes and claims a device for measuring blood pressure; U.S. Pat. No. 5,930,143 describes and claims a device for measuring the dimensions of machine tools; U.S. Pat. No. 5,279,044 describes and claims a measuring device for determining an absolute position of a movable element; U.S. Pat. No. 5,186,042 describes and claims a device for measuring action force of a wheel; and U.S. Pat. No. 4,246,774 describes and claims a device for measuring the draft of smoking articles such as cigarettes.

As for tissues not yet demonstrated to express hGDMLP-1, the hGDMLP-1 nucleic acid probes of the present invention are currently available as tools for surveying such tissues to detect the presence of hGDMLP-1 nucleic acids.

Survey tools—i.e., tools for determining the presence and/or location of a desired object by search of an area—are well known in many arts, not just in molecular biology, and are known to possess credible, specific, and substantial utility. For example, U.S. Pat. No. 6,046,800 describes and claims a device for surveying an area for objects that move; U.S. Pat. No. 6,025,201 describes and claims an apparatus for locating and discriminating platelets from non-platelet particles or cells on a cell-by-cell basis in a whole blood sample; U.S. Pat. No. 5,990,689 describes and claims a device for detecting and locating anomalies in the electromagnetic protection of a system; U.S. Pat. No. 5,984,175 describes and claims a device for detecting and identifying wearable user identification units; U.S. Pat. No. 3,980,986 describes and claims a tool for finding the position of a drill bit working at the bottom of a borehole.

As noted above, the nucleic acid probes of the present invention are useful in constructing microarrays; the microarrays, in turn, are products of manufacture that are useful for measuring and for surveying gene expression.

When included on a microarray, each hGDMLP-1 nucleic acid probe makes the microarray specifically useful for detecting that portion of the hGDMLP-1 gene included within the probe, thus imparting upon the microarray device the ability to detect a signal where, absent such probe, it would have reported no signal. This utility makes each individual probe on such microarray akin to an antenna, circuit, firmware or software element included in an electronic apparatus, where the antenna, circuit, firmware or software element imparts upon the apparatus the ability newly and additionally to detect signal in a portion of the radio-frequency spectrum where previously it could not; such devices are known to have specific, substantial, and credible utility.

Changes in the level of expression need not be observed for the measurement of expression to have utility.

For example, where gene expression analysis is used to assess toxicity of chemical agents on cells, the failure of the agent to change a gene's expression level is evidence that the drug likely does not affect the pathway of which the gene's expressed protein is a part. Analogously, where gene expression analysis is used to assess side effects of pharmacologic agents—whether in lead compound discovery or in subsequent screening of lead compound derivatives—the inability of the agent to alter a gene's expression level is evidence that the drug does not affect the pathway of which the gene's expressed protein is a part. WO 99/58720, incorporated herein by reference in its entirety, provides methods for quantifying the relatedness of a first and second gene expression profile and for ordering the relatedness of a plurality of gene expression profiles, without regard to the identity or function of the genes whose expression is used in the calculation.

Gene expression analysis, including gene expression analysis by microarray hybridization, is, of course, principally a laboratory-based art. Devices and apparatus used principally in laboratories to facilitate laboratory research are well-established to possess specific, substantial, and credible utility. For example, U.S. Pat. No. 6,001,233 describes and claims a gel electrophoresis apparatus having a cam-activated clamp; for example, U.S. Pat. No. 6,051,831 describes and claims a high mass detector for use in time-of-flight mass spectrometers; for example, U.S. Pat. No. 5,824,269 describes and claims a flow cytometer—few gel electrophoresis apparatuses, TOF-MS devices, or flow cytometers are sold for home use.

Indeed, and in particular, nucleic acid microarrays, as devices intended for laboratory use in measuring gene expression, are well-established to have specific, substantial and credible utility. Thus, the microarrays of the present invention have at least the specific, substantial and credible utilities of the microarrays claimed as devices and articles of manufacture in the following U.S. patents, the disclosures of each of which is incorporated herein by reference: U.S. Pat. No. 5,445,934 ("Array of oligonucleotides on a solid substrate"); U.S. Pat. No. 5,744,305 ("Arrays of materials attached to a substrate"); and U.S. Pat. No. 6,004,752 ("Solid support with attached molecules").

Genome-derived single exon probes and genome-derived single exon probe microarrays have the additional utility, inter alia, of permitting high-throughput detection of splice variants of the nucleic acids of the present invention, as further described in copending and commonly owned U.S. patent application Ser. No. 09/632,366, filed Aug. 3, 2000, the disclosure of which is incorporated herein by reference in its entirety.

The isolated nucleic acids of the present invention can also be used to prime synthesis of nucleic acid, for purpose of either analysis or isolation, using mRNA, cDNA, or genomic DNA as template.

For use as primers, at least 17 contiguous nucleotides of the isolated nucleic acids of the present invention will be used. Often, at least 18, 19, or 20 contiguous nucleotides of the nucleic acids of the present invention will be used, and on occasion at least 20, 22, 24, or 25 contiguous nucleotides of the nucleic acids of the present invention will be used, and even 30 nucleotides or more of the nucleic acids of the present invention can be used to prime specific synthesis.

The nucleic acid primers of the present invention can be used, for example, to prime first strand cDNA synthesis on an mRNA template.

Such primer extension can be done directly to analyze the message. Alternatively, synthesis on an mRNA template can be done to produce first strand cDNA. The first strand cDNA can thereafter be used, inter alia, directly as a single-stranded probe, as above-described, as a template for sequencing—permitting identification of alterations, including deletions, insertions, and substitutions, both normal allelic variants and mutations associated with abnormal phenotypes- or as a template, either for second strand cDNA synthesis (e.g., as an antecedent to insertion into a cloning or expression vector), or for amplification.

The nucleic acid primers of the present invention can also be used, for example, to prime single base extension (SBE) for SNP detection (see, e.g., U.S. Pat. No. 6,004,744, the disclosure of which is incorporated herein by reference in its entirety).

As another example, the nucleic acid primers of the present invention can be used to prime amplification of hGDMLP-1 nucleic acids, using transcript-derived or genomic DNA as template.

Primer-directed amplification methods are now well-established in the art. Methods for performing the polymerase chain reaction (PCR) are compiled, inter alia, in McPherson, *PCR (Basics: From Background to Bench)*, Springer Verlag (2000) (ISBN: 0387916008); Innis et al. (eds.), *PCR Applications: Protocols for Functional Genomics*, Academic Press (1999) (ISBN: 0123721857); Gelfand et al. (eds.), *PCR Strategies*, Academic Press (1998) (ISBN: 0123721822); Newton et al., *PCR*, Springer-Verlag New York (1997) (ISBN: 0387915060); Burke (ed.), *PCR: Essential Techniques*, John Wiley & Son Ltd (1996) (ISBN: 047195697X); White (ed.), *PCR Cloning Protocols*: From Molecular Cloning to Genetic Engineering, Vol. 67, Humana Press (1996) (ISBN: 0896033430); McPherson et al. (eds.), *PCR 2: A Practical Approach*, Oxford University Press, Inc. (1995) (ISBN: 0199634254), the disclosures of which are incorporated herein by reference in their entireties. Methods for performing RT-PCR are collected, e.g., in Siebert et al. (eds.), *Gene Cloning and Analysis by RT-PCR*, Eaton Publishing Company/Bio Techniques Books Division, 1998 (ISBN: 1881299147); Siebert (ed.), *PCR Technique:RT-PCR*, Eaton Publishing Company/BioTechniques Books (1995) (ISBN:1881299139), the disclosure of which is incorporated herein by reference in its entirety.

Isothermal amplification approaches, such as rolling circle amplification, are also now well-described. See, e.g., Schweitzer et al., *Curr. Opin. Biotechnol.* 12(1):21–7 (2001); U.S. Pat. Nos. 5,854,033 and 5,714,320 and international patent publications WO 97/19193 and WO 00/15779, the disclosures of which are incorporated herein by reference in their entireties. Rolling circle amplification can be combined with other techniques to facilitate SNP detection. See, e.g., Lizardi et al., *Nature Genet.* 19(3):225–32 (1998).

As further described below, nucleic acids of the present invention, inserted into vectors that flank the nucleic acid insert with a phage promoter, such as T7, T3, or SP6 promoter, can be used to drive in vitro expression of RNA complementary to either strand of the nucleic acid of the present invention. The RNA can be used, inter alia, as a single-stranded probe, in cDNA-mRNA subtraction, or for in vitro translation.

As will be further discussed herein below, nucleic acids of the present invention that encode hGDMLP-1 protein or portions thereof can be used, inter alia, to express the hGDMLP-1 proteins or protein fragments, either alone, or as part of fusion proteins.

Expression can be from genomic nucleic acids of the present invention, or from transcript-derived nucleic acids of the present invention.

Where protein expression is effected from genomic DNA, expression will typically be effected in eukaryotic, typically mammalian, cells capable of splicing introns from the initial RNA transcript. Expression can be driven from episomal vectors, such as EBV-based vectors, or can be effected from genomic DNA integrated into a host cell chromosome. As will be more fully described below, where expression is from transcript-derived (or otherwise intron-less) nucleic acids of the present invention, expression can be effected in wide variety of prokaryotic or eukaryotic cells.

Expressed in vitro, the protein, protein fragment, or protein fusion can thereafter be isolated, to be used, inter alia, as a standard in immunoassays specific for the proteins, or protein isoforms, of the present invention; to be used as a therapeutic agent, e.g., to be administered as passive replacement therapy in individuals deficient in the proteins of the present invention, or to be administered as a vaccine; to be used for in vitro production of specific antibody, the antibody thereafter to be used, e.g., as an analytical reagent for detection and quantitation of the proteins of the present invention or to be used as an immunotherapeutic agent.

The isolated nucleic acids of the present invention can also be used to drive in vivo expression of the proteins of the present invention. In vivo expression can be driven from a vector—typically a viral vector, often a vector based upon a replication incompetent retrovirus, an adenovirus, or an adeno-associated virus (AAV)—for purpose of gene therapy. In vivo expression can also be driven from signals endogenous to the nucleic acid or from a vector, often a plasmid vector, such as pVAX1 (Invitrogen, Carlsbad, Calif., USA), for purpose of "naked" nucleic acid vaccination, as further described in U.S. Pat. Nos. 5,589,466; 5,679,647; 5,804, 566; 5,830,877; 5,843,913; 5,880,104; 5,958,891; 5,985, 847; 6,017,897; 6,110,898; 6,204,250, the disclosures of which are incorporated herein by reference in their entireties.

The nucleic acids of the present invention can also be used for antisense inhibition of transcription or translation. See Phillips (ed.), *Antisense Technology, Part B*, Methods in Enzymology Vol. 314, Academic Press, Inc. (1999) (ISBN: 012182215X); Phillips (ed.), *Antisense Technology, Part A*, Methods in Enzymology Vol. 313, Academic Press, Inc. (1999) (ISBN: 0121822141); Hartmann et al. (eds.), *Manual of Antisense Methodology* (Perspectives in Antisense Science), Kluwer Law International (1999) (ISBN:079238539X); Stein et al. (eds.), *Applied Antisense Oligonucleotide Technology*, Wiley-Liss (cover (1998) (ISBN: 0471172790); Agrawal et al. (eds.), *Antisense Research and Application*, Springer-Verlag New York, Inc. (1998) (ISBN: 3540638334); Lichtenstein et al. (eds.), *Antisense Technology: A Practical Approach*, Vol. 185, Oxford University Press, INC. (1998) (ISBN: 0199635838); Gibson (ed.), *Antisense and Ribozyme Methodology: Laboratory Companion*, Chapman & Hall (1997) (ISBN: 3826100794); Chadwick et al. (eds.), *Oligonucleotides as Therapeutic Agents—Symposium No. 209*, John Wiley & Son Ltd (1997) (ISBN: 0471972797), the disclosures of which are incorporated herein by reference in their entireties.

Nucleic acids of the present invention that encode full-length human hGDMLP-1 protein isoforms, particularly cDNAs encoding full-length isoforms, have additional, well-recognized, immediate, real world as commercial products of manufacture suitable for sale. For example, Invitrogen Corp. (Carlsbad, Calif., USA), through its Research Genetics subsidiary, sells full length human cDNAs (other than hGDMLP-1) cloned into one of a selection of expression vectors as GeneStorm® expression-ready clones; utility is specific for the gene, since each gene is capable of being ordered separately and has a distinct catalogue number, and utility is substantial, each clone selling for $650.00 US.

Nucleic acids of the present invention that include genomic regions encoding the human hGDMLP-1 protein, or portions thereof, have yet further utilities.

For example, genomic nucleic acids of the present invention can be used as amplification substrates, e.g. for preparation of genome-derived single exon probes of the present invention, described above, and further described in copending and commonly-owned U.S. patent application Ser. No. 09/774,203, filed Jan. 29, 2001, and Ser. No. 09/632,366, filed Aug. 3, 2000 and commonly-owned and copending U.S. provisional patent application No. 60/207,456, filed May 26, 2000, No. 60/234,687, filed Sep. 21, 2000, No. 60/236,359, filed Sep. 27, 2000, the disclosures of which are incorporated herein by reference in their entireties.

As another example, genomic nucleic acids of the present invention can be integrated non-homologously into the genome of somatic cells, with or without amplification of the insertional locus, in order, e.g., to create stable cell lines capable of producing the proteins of the present invention.

As another example, more fully described herein below, genomic nucleic acids of the present invention can be integrated nonhomologously into embryonic stem (ES) cells to create transgenic non-human animals capable of producing the proteins of the present invention.

Genomic nucleic acids of the present invention can also be used to target homologous recombination to the human hGDMLP-1 locus. See, e.g., U.S. Pat. Nos. 6,187,305; 6,204,061; 5,631,153; 5,627,059; 5,487,992; 5,464,764; 5,614,396; 5,527,695 and 6,063,630; and Kmiec et al. (eds.), *Gene Targeting Protocols*, Vol. 133, Humana Press (2000) (ISBN: 0896033600); Joyner (ed.), *Gene Targeting: A Practical Approach*, Oxford University Press, Inc. (2000) (ISBN: 0199637938); Sedivy et al., *Gene Targeting*, Oxford University Press (1998) (ISBN: 071677013X); Tymms et al. (eds.), *Gene Knockout Protocols*, Humana Press (2000) (ISBN: 0896035727); Mak et al. (eds.), *The Gene Knockout FactsBook*, Vol. 2, Academic Press, Inc. (1998) (ISBN: 0124660444); Torres et al., *Laboratory Protocols for Conditional Gene Targeting*, Oxford University Press (1997) (ISBN: 019963677X); Vega (ed.), *Gene Targeting*, CRC Press, LLC (1994) (ISBN: 084938950X), the disclosures of which are incorporated herein by reference in their entireties.

Where the genomic region includes transcription regulatory elements, homologous recombination can be used to alter the expression of hGDMLP-1, both for purpose of in vitro production of hGDMLP-1 protein from human cells, and for purpose of gene therapy. See, e.g., U.S. Pat. Nos. 5,981,214, 6,048,524; 5,272,071, incorporated herein by reference in their entireties.

Fragments of the nucleic acids of the present invention smaller than those typically used for homologous recombination can also be used for targeted gene correction or alteration, possibly by cellular mechanisms different from those engaged during homologous recombination.

For example, partially duplexed RNA/DNA chimeras have been shown to have utility in targeted gene correction, U.S. Pat. Nos. 5,945,339, 5,888,983, 5,871,984, 5,795,972, 5,780,296, 5,760,012, 5,756,325, 5,731,181, the disclosures of which are incorporated herein by reference in their entireties. So too have small oligonucleotides fused to triplexing domains have been shown to have utility in targeted gene correction, Culver et al., "Correction of chromosomal point mutations in human cells with bifunctional oligonucleotides," *Nature Biotechnol.* 17(10):989–93 (1999), as have oligonucleotides having modified terminal bases or modified terminal internucleoside bonds, Gamper et al., *Nucl. Acids Res.* 28(21):4332–9 (2000), the disclosures of which are incorporated herein by reference.

The isolated nucleic acids of the present invention can also be used to provide the initial substrate for recombinant engineering of hGDMLP-1 protein variants having desired phenotypic improvements. Such engineering includes, for example, site-directed mutagenesis, random mutagenesis with subsequent functional screening, and more elegant schemes for recombinant evolution of proteins, as are described, inter alia, in U.S. Pat. Nos. 6,180,406; 6,165,793; 6,117,679; and 6,096,548, the disclosures of which are incorporated herein by reference in their entireties.

Nucleic acids of the present invention can be obtained by using the labeled probes of the present invention to probe nucleic acid samples, such as genomic libraries, cDNA libraries, and mRNA samples, by standard techniques. Nucleic acids of the present invention can also be obtained by amplification, using the nucleic acid primers of the present invention, as further demonstrated in Example 1, herein below. Nucleic acids of the present invention of fewer than about 100 nt can also be synthesized chemically, typically by solid phase synthesis using commercially available automated synthesizers.

Vectors and Host Cells

In another aspect, the present invention provides vectors that comprise one or more of the isolated nucleic acids of the present invention, and host cells in which such vectors have been introduced.

The vectors can be used, inter alia, for propagating the nucleic acids of the present invention in host cells (cloning vectors), for shuttling the nucleic acids of the present invention between host cells derived from disparate organisms (shuttle vectors), for inserting the nucleic acids of the present invention into host cell chromosomes (insertion vectors), for expressing sense or antisense RNA transcripts of the nucleic acids of the present invention in vitro or within a host cell, and for expressing polypeptides encoded by the nucleic acids of the present invention, alone or as fusions to heterologous polypeptides. Vectors of the present invention will often be suitable for several such uses.

Vectors are by now well-known in the art, and are described, inter alia, in Jones et al. (eds.), *Vectors: Cloning Applications: Essential Techniques* (Essential Techniques Series), John Wiley & Son Ltd 1998 (ISBN: 047196266X); Jones et al. (eds.), *Vectors: Expression Systems: Essential Techniques* (Essential Techniques Series), John Wiley & Son Ltd, 1998 (ISBN:0471962678); Gacesa et al., *Vectors: Essential Data*, John Wiley & Sons, 1995 (ISBN: 0471948411); Cid-Arregui (eds.), *Viral Vectors: Basic Science and Gene Therapy*, Eaton Publishing Co., 2000 (ISBN: 188129935X); Sambrook et al., *Molecular Cloning: A Laboratory Manual* ($3^{rd}$ ed.), Cold Spring Harbor Laboratory Press, 2001 (ISBN: 0879695773); Ausubel et al. (eds.), *Short Protocols in Molecular Biology: A Compendium of Methods from Current Protocols in Molecular Biology* ($4^{th}$ ed.), John Wiley & Sons, 1999 (ISBN: 047132938X), the disclosures of which are incorporated herein by reference in their entireties. Furthermore, an enormous variety of vectors are available commercially. Use of existing vectors and modifications thereof being well within the skill in the art, only basic features need be described here.

Typically, vectors are derived from virus, plasmid, prokaryotic or eukaryotic chromosomal elements, or some combination thereof, and include at least one origin of replication, at least one site for insertion of heterologous nucleic acid, typically in the form of a polylinker with multiple, tightly clustered, single cutting restriction sites, and at least one selectable marker, although some integrative vectors will lack an origin that is functional in the host to be chromosomally modified, and some vectors will lack selectable markers. Vectors of the present invention will further include at least one nucleic acid of the present invention inserted into the vector in at least one location.

Where present, the origin of replication and selectable markers are chosen based upon the desired host cell or host cells; the host cells, in turn, are selected based upon the desired application.

For example, prokaryotic cells, typically *E. coli*, are typically chosen for cloning. In such case, vector replication is predicated on the replication strategies of coliform-infecting phage—such as phage lambda, M13, T7, T3 and P1—or on the replication origin of autonomously replicating episomes, notably the ColE1 plasmid and later derivatives, including pBR322 and the pUC series plasmids. Where *E. coli* is used as host, selectable markers are, analogously, chosen for selectivity in gram negative bacteria: e.g., typical markers confer resistance to antibiotics, such as ampicillin, tetracycline, chloramphenicol, kanamycin, streptomycin, zeocin; auxotrophic markers can also be used.

As another example, yeast cells, typically *S. cerevisiae*, are chosen, inter alia, for eukaryotic genetic studies, due to the ease of targeting genetic changes by homologous recombination and to the ready ability to complement genetic defects using recombinantly expressed proteins, for identification of interacting protein components, e.g. through use of a two-hybrid system, and for protein expression. Vectors of the present invention for use in yeast will typically, but not invariably, contain an origin of replication suitable for use in yeast and a selectable marker that is functional in yeast.

Integrative YIp vectors do not replicate autonomously, but integrate, typically in single copy, into the yeast genome at low frequencies and thus replicate as part of the host cell chromosome; these vectors lack an origin of replication that is functional in yeast, although they typically have at least one origin of replication suitable for propagation of the vector in bacterial cells. YEp vectors, in contrast, replicate episomally and autonomously due to presence of the yeast 2 micron plasmid origin (2 $\mu$m ori). The YCp yeast centromere plasmid vectors are autonomously replicating vectors containing centromere sequences, CEN, and autonomously replicating sequences, ARS; the ARS sequences are believed to correspond to the natural replication origins of yeast chromosomes.

Selectable markers in yeast vectors include a variety of auxotrophic markers, the most common of which are (in *Saccharomyces cerevisiae*) URA3, HIS3, LEU2, TRP1 and LYS2, which complement specific auxotrophic mutations, such as ura3-52, his3-D1, leu2-D1, trp1-D1 and lys2-201. The URA3 and LYS2 yeast genes further permit negative selection based on specific inhibitors, 5-fluoro-orotic acid (FOA) and $\alpha$-aminoadipic acid ($\alpha$AA), respectively, that prevent growth of the prototrophic strains but allows growth of the ura3 and lys2 mutants, respectively. Other selectable markers confer resistance to, e.g., zeocin.

As yet another example, insect cells are often chosen for high efficiency protein expression. Where the host cells are from *Spodoptera frugiperda*—e.g., Sf9 and Sf21 cell lines, and expresSF™ cells (Protein Sciences Corp., Meriden, Conn., USA)—the vector replicative strategy is typically based upon the baculovirus life cycle. Typically, baculovirus transfer vectors are used to replace the wild-type AcMNPV polyhedrin gene with a heterologous gene of interest. Sequences that flank the polyhedrin gene in the wild-type genome are positioned 5' and 3' of the expression cassette on the transfer vectors. Following cotransfection with AcMNPV DNA, a homologous recombination event occurs between these sequences resulting in a recombinant virus carrying the gene of interest and the polyhedrin or p10 promoter. Selection can be based upon visual screening for lacZ fusion activity.

As yet another example, mammalian cells are often chosen for expression of proteins intended as pharmaceutical agents, and are also chosen as host cells for screening of potential agonist and antagonists of a protein or a physiological pathway.

Where mammalian cells are chosen as host cells, vectors intended for autonomous extrachromosomal replication will typically include a viral origin, such as the SV40 origin (for replication in cell lines expressing the large T-antigen, such as COS1 and COS7 cells), the papillomavirus origin, or the EBV origin for long term episomal replication (for use, e.g., in 293-EBNA cells, which constitutively express the EBV EBNA-1 gene product and adenovirus E1A). Vectors intended for integration, and thus replication as part of the mammalian chromosome, can, but need not, include an origin of replication functional in mammalian cells, such as the SV40 origin. vectors based upon viruses, such as adenovirus, adeno-associated virus, vaccinia virus, and various mammalian retroviruses, will typically replicate according to the viral replicative strategy.

Selectable markers for use in mammalian cells include resistance to neomycin (G418), blasticidin, hygromycin and to zeocin, and selection based upon the purine salvage pathway using HAT medium.

Plant cells can also be used for expression, with the vector replicon typically derived from a plant virus (e.g., cauliflower mosaic virus, CaMV; tobacco mosaic virus, TMV) and selectable markers chosen for suitability in plants.

For propagation of nucleic acids of the present invention that are larger than can readily be accomodated in vectors derived from plasmids or virus, the invention further provides artificial chromosomes—BACs, YACs, and HACs—that comprise hGDMLP-1 nucleic acids, often genomic nucleic acids.

The BAC system is based on the well-characterized *E. coli* F-factor, a low copy plasmid that exists in a supercoiled circular form in host cells. The structural features of the F-factor allow stable maintenance of individual human DNA clones as well as easy manipulation of the cloned DNA. See Shizuya et al., *Keio J. Med.* 50(1):26–30 (2001); Shizuya et al., *Proc. Natl. Acad. Sci. USA* 89(18):8794–7 (1992).

YACs are based on yeast linear plasmids, denoted YLp, containing homologous or heterologous DNA sequences that function as telomeres (TEL) in vivo, as well as containing yeast ARS (origins of replication) and CEN (centromeres) segments.

HACs are human artifical chromosomes. Kuroiwa et al., *Nature Biotechnol.* 18(10):1086–90 (2000); Henning et al., *Proc. Natl. Acad. Sci. USA* 96(2):592–7 (1999); Harrington et al., *Nature Genet.* 15(4):345–55 (1997). In one version, long synthetic arrays of alpha satellite DNA are combined with telomeric DNA and genomic DNA to generate linear microchromosomes that are mitotically and cytogenetically stable in the absence of selection.

Vectors of the present invention will also often include elements that permit in vitro transcription of RNA from the inserted heterologous nucleic acid. Such vectors typically include a phage promoter, such as that from T7, T3, or SP6, flanking the nucleic acid insert. Often two different such promoters flank the inserted nucleic acid, permitting separate in vitro production of both sense and antisense strands.

Expression vectors of the present invention—that is, those vectors that will drive expression of polypeptides from the inserted heterologous nucleic acid—will often include a variety of other genetic elements operatively linked to the protein-encoding heterologous nucleic acid insert, typically genetic elements that drive transcription, such as promoters and enhancer elements, those that facilitate RNA processing, such as transcription termination and/or polyadenylation signals, and those that facilitate translation, such as ribosomal consensus sequences.

For example, vectors for expressing proteins of the present invention in prokaryotic cells, typically *E. coli*, will include a promoter, often a phage promoter, such as phage lambda pL promoter, the trc promoter, a hybrid derived from the trp and lac promoters, the bacteriophage T7 promoter (in *E. coli* cells engineered to express the T7 polymerase), or the araBAD operon. Often, such prokaryotic expression vectors will further include transcription terminators, such as the aspA terminator, and elements that facilitate translation, such as a consensus ribosome binding site and translation termination codon, Schomer et al., *Proc. Natl. Acad. Sci. USA* 83:8506–8510 (1986).

As another example, vectors for expressing proteins of the present invention in yeast cells, typically *S. cerevisiae*, will include a yeast promoter, such as the CYC1 promoter, the GAL1 promoter, ADH1 promoter, or the GPD promoter, and will typically have elements that facilitate transcription termination, such as the transcription termination signals from the CYC1 or ADH1 gene.

As another example, vectors for expressing proteins of the present invention in mammalian cells will include a promoter active in mammalian cells. Such promoters are often drawn from mammalian viruses—such as the enhancer-promoter sequences from the immediate early gene of the human cytomegalovirus (CMV), the enhancer-promoter sequences from the Rous sarcoma virus long terminal repeat (RSV LTR), and the enhancer-promoter from SV40. Often, expression is enhanced by incorporation of polyadenylation sites, such as the late SV40 polyadenylation site and the polyadenylation signal and transcription termination sequences from the bovine growth hormone (BGH) gene, and ribosome binding sites. Furthermore, vectors can include introns, such as intron II of rabbit β-globin gene and the SV40 splice elements.

Vector-drive protein expression can be constitutive or inducible.

Inducible vectors include either naturally inducible promoters, such as the trc promoter, which is regulated by the lac operon, and the pL promoter, which is regulated by tryptophan, the MMTV-LTR promoter, which is inducible by dexamethasone, or can contain synthetic promoters and/or additional elements that confer inducible control on adjacent promoters. Examples of inducible synthetic promoters are the hybrid Plac/ara-1 promoter and the PLtetO-1 promoter. The PltetO-1 promoter takes advantage of the high expression levels from the PL promoter of phage lambda, but replaces the lambda repressor sites with two copies of operator 2 of the Tn10 tetracycline resistance operon, causing this promoter to be tightly repressed by the Tet repressor protein and induced in response to tetracycline (Tc) and Tc derivatives such as anhydrotetracycline.

As another example of inducible elements, hormone response elements, such as the glucocorticoid response element (GRE) and the estrogen response element (ERE), can confer hormone inducibility where vectors are used for expression in cells having the respective hormone receptors. To reduce background levels of expression, elements responsive to ecdysone, an insect hormone, can be used instead, with coexpression of the ecdysone receptor.

Expression vectors can be designed to fuse the expressed polypeptide to small protein tags that facilitate purification and/or visualization.

For example, proteins of the present invention can be expressed with a polyhistidine tag that facilitates purification of the fusion protein by immobilized metal affinity chromatography, for example using NiNTA resin (Qiagen Inc., Valencia, Calif., USA) or TALON™ resin (cobalt immobilized affinity chromatography medium, Clontech Labs, Palo Alto, Calif., USA). As another example, the fusion protein can include a chitin-binding tag and self-excising intein, permitting chitin-based purification with self-removal of the fused tag (IMPACT™ system, New England Biolabs, Inc., Beverley, Mass., USA). Alternatively, the fusion protein can include a calmodulin-binding peptide tag, permitting purification by calmodulin affinity resin (Stratagene, La Jolla, Calif., USA), or a specifically excisable fragment of the biotin carboxylase carrier protein, permitting purification of in vivo biotinylated protein using an avidin resin and subsequent tag removal (Promega, Madison, Wis., USA). As another useful alternative, the proteins of the present invention can be expressed as a fusion to glutathione-S-transferase, the affinity and specificity of binding to glutathione permitting purification using glutathione affinity resins, such as Glutathione-Superflow Resin (Clontech Laboratories, Palo Alto, Calif., USA), with subsequent elution with free glutathione; proteins made in such systems can be designed to include heparin, thrombin, or factor Xa protease cleavage sites so that the cloned polypeptide of interest can be released from the GST moiety at will.

Other tags include, for example, the Xpress epitope, detectable by anti-Xpress antibody (Invitrogen, Carlsbad, Calif., USA), a myc tag, detectable by anti-myc tag antibody, the VS epitope, detectable by anti-VS antibody (Invitrogen, Carlsbad, Calif., USA), FLAG® epitope, detectable by anti-FLAG® antibody (Stratagene, La Jolla, Calif., USA), and the HA epitope.

For secretion of expressed proteins, vectors can include appropriate sequences that encode secretion signals, such as leader peptides. For example, the pSecTag2 vectors (Invitrogen, Carlsbad, Calif., USA) are 5.2 kb mammalian expression vectors that carry the secretion signal from the V-J2-C region of the mouse Ig kappa-chain for efficient secretion of recombinant proteins from a variety of mammalian cell lines.

Expression vectors can also be designed to fuse proteins encoded by the heterologous nucleic acid insert to polypeptides larger than purification and/or identification tags. Useful protein fusions include those that permit display of the encoded protein on the surface of a phage or cell, fusions to intrinsically fluorescent proteins, such as those having a green fluorescent protein (GFP)-like chromophore, fusions to the IgG Fc region, and fusions for use in two hybrid systems.

Vectors for phage display fuse the encoded polypeptide to, e.g., the gene III protein (pIII) or gene VIII protein (pVIII) for display on the surface of filamentous phage, such as M13. See Barbas et al., *Phage Display: A Laboratory Manual*, Cold Spring Harbor Laboratory Press (2001) (ISBN 0-87969-546-3); Kay et al. (eds.), *Phage Display of Peptides and Proteins: A Laboratory Manual*, San Diego: Academic Press, Inc., 1996; Abelson et al. (eds.), *Combinatorial Chemistry*, Methods in Enzymology vol. 267, Academic Press (May 1996).

Vectors for yeast display, e.g. the pYD1 yeast display vector (Invitrogen, Carlsbad, Calif., USA), use the a-agglutinin yeast adhesion receptor to display recombinant protein on the surface of *S. cerevisiae*. Vectors for mammalian display, e.g., the pDisplay™ vector (Invitrogen, Carlsbad, Calif., USA), target recombinant proteins using an N-terminal cell surface targeting signal and a C-terminal transmembrane anchoring domain of platelet derived growth factor receptor.

A wide variety of vectors now exist that fuse proteins encoded by heterologous nucleic acids to the chromophore of the substrate-independent, intrinsically fluorescent green fluorescent protein from *Aequorea victoria* ("GFP") and its variants. These proteins are intrinsically fluorescent: the GFP-like chromophore is entirely encoded by its amino acid sequence and can fluoresce without requirement for cofactor or substrate.

Structurally, the GFP-like chromophore comprises an 11-stranded β-barrel (β-can) with a central α-helix, the central α-helix having a conjugated n-resonance system that includes two aromatic ring systems and the bridge between them. The π-resonance system is created by autocatalytic cyclization among amino acids; cyclization proceeds through an imidazolinone intermediate, with subsequent dehydrogenation by molecular oxygen at the Cα-Cβ bond of a participating tyrosine.

The GFP-like chromophore can be selected from GFP-like chromophores found in naturally occurring proteins, such as *A. victoria* GFP (GenBank accession number AAA27721), *Renilla reniformis* GFP, FP583 (GenBank accession no. AF168419) (DsRed), FP593 (AF272711), FP483 (AF168420), FP484 (AF168424), FP595 (AF246709), FP486 (AF168421), FP538 (AF168423), and FP506 (AF168422), and need include only so much of the native protein as is needed to retain the chromophore's intrinsic fluorescence. Methods for determining the minimal domain required for fluorescence are known in the art. Li et al., "Deletions of the *Aequorea victoria* Green Fluorescent Protein Define the Minimal Domain Required for Fluorescence," *J. Biol. Chem.* 272:28545–28549 (1997).

Alternatively, the GFP-like chromophore can be selected from GFP-like chromophores modified from those found in nature. Typically, such modifications are made to improve recombinant production in heterologous expression systems (with or without change in protein sequence), to alter the excitation and/or emission spectra of the native protein, to facilitate purification, to facilitate or as a consequence of cloning, or are a fortuitous consequence of research investigation.

The methods for engineering such modified GFP-like chromophores and testing them for fluorescence activity, both alone and as part of protein fusions, are well-known in the art. Early results of these efforts are reviewed in Heim et al., *Curr. Biol.* 6:178–182 (1996), incorporated herein by reference in its entirety; a more recent review, with tabulation of useful mutations, is found in Palm et al., "Spectral Variants of Green Fluorescent Protein," in *Green Fluorescent Proteins*, Conn (ed.), *Methods Enzymol.* vol. 302, pp. 378–394 (1999), incorporated herein by reference in its entirety. A variety of such modified chromophores are now commercially available and can readily be used in the fusion proteins of the present invention.

For example, EGFP ("enhanced GFP"), Cormack et al., *Gene* 173:33–38 (1996); U.S. Pat. Nos. 6,090,919 and 5,804,387, is a red-shifted, human codon-optimized variant of GFP that has been engineered for brighter fluorescence, higher expression in mammalian cells, and for an excitation spectrum optimized for use in flow cytometers. EGFP can usefully contribute a GFP-like chromophore to the fusion proteins of the present invention. A variety of EGFP vectors, both plasmid and viral, are available commercially (Clontech Labs, Palo Alto, Calif., USA), including vectors for bacterial expression, vectors for N-terminal protein fusion expression, vectors for expression of C-terminal protein fusions, and for bicistronic expression.

Toward the other end of the emission spectrum, EBFP ("enhanced blue fluorescent protein") and BFP2 contain four amino acid substitutions that shift the emission from green to blue, enhance the brightness of fluorescence and improve solubility of the protein, Heim et al., *Curr. Biol.* 6:178–182 (1996); Cormack et al., *Gene* 173:33–38 (1996). EBFP is optimized for expression in mammalian cells whereas BFP2, which retains the original jellyfish codons, can be expressed in bacteria; as is further discussed below, the host cell of production does not affect the utility of the resulting fusion protein. The GFP-like chromophores from EBFP and BFP2 can usefully be included in the fusion proteins of the present invention, and vectors containing these blue-shifted variants are available from Clontech Labs (Palo Alto, Calif., USA).

Analogously, EYFP ("enhanced yellow fluorescent protein"), also available from Clontech Labs, contains four amino acid substitutions, different from EBFP, Ormö et al., *Science* 273:1392–1395 (1996), that shift the emission from green to yellowish-green. Citrine, an improved yellow fluorescent protein mutant, is described in Heikal et al., *Proc. Natl. Acad. Sci. USA* 97:11996–12001 (2000). ECFP ("enhanced cyan fluorescent protein") (Clontech Labs, Palo Alto, Calif., USA) contains six amino acid substitutions, one of which shifts the emission spectrum from green to cyan. Heim et al., *Curr. Biol.* 6:178–182 (1996); Miyawaki et al., *Nature* 388:882–887 (1997). The GFP-like chromophore of each of these GFP variants can usefully be included in the fusion proteins of the present invention.

The GFP-like chromophore can also be drawn from other modified GFPs, including those described in U.S. Pat. Nos. 6,124,128; 6,096,865; 6,090,919; 6,066,476; 6,054,321; 6,027,881; 5,968,750; 5,874,304; 5,804,387; 5,777,079; 5,741,668; and 5,625,048, the disclosures of which are incorporated herein by reference in their entireties. See also Conn (ed.), *Green Fluorescent Protein*, Methods in Enzymology, vol. 302, Academic Press, Inc. 1999 (ISBN: 0121822036).

Fusions to the IgG Fc region increase serum half life of protein pharmaceutical products through interaction with the FcRn receptor (also denominated the FcRp receptor and the Brambell receptor, FcRb), further described in international patent application nos. WO 97/43316, WO 97/34631, WO 96/32478, WO 96/18412, incorporated herein by reference in their entireties.

For long-term, high-yield recombinant production of the proteins, protein fusions, and protein fragments of the present invention, stable expression is preferred.

Stable expression is readily achieved by integration into the host cell genome of vectors having selectable markers, followed by selection for integrants.

For example, the pUB6/V5-His A, B, and C vectors (Invitrogen, Carlsbad, Calif., USA) are designed for high-level stable expression of heterologous proteins in a wide range of mammalian tissue types and cell lines. pUB6/V5-His uses the promoter/enhancer sequence from the human ubiquitin C gene to drive expression of recombinant proteins: expression levels in 293, CHO, and NIH3T3 cells are comparable to levels from the CMV and human EF-1α promoters. The bsd gene permits rapid selection of stably transfected mammalian cells with the potent antibiotic blasticidin.

Replication incompetent retroviral vectors, typically derived from Moloney murine leukemia virus, prove particularly useful for creating stable transfectants having integrated provirus. The highly efficient transduction machinery of retroviruses, coupled with the availability of a variety of packaging cell lines—such as RetroPack™PT 67, EcoPack2™-293, AmphoPack-293, GP2–293 cell lines (all available from Clontech Laboratories, Palo Alto, Calif., USA)—allow a wide host range to be infected with high efficiency; varying the multiplicity of infection readily adjusts the copy number of the integrated provirus. Retroviral vectors are available with a variety of selectable markers, such as resistance to neomycin, hygromycin, and puromycin, permitting ready selection of stable integrants.

The present invention further includes host cells comprising the vectors of the present invention, either present episomally within the cell or integrated, in whole or in part, into the host cell chromosome.

Among other considerations, some of which are described above, a host cell strain may be chosen for its ability to process the expressed protein in the desired fashion. Such post-translational modifications of the polypeptide include, but are not limited to, acetylation, carboxylation, glycosylation, phosphorylation, lipidation, and acylation, and it is an aspect of the present invention to provide hGDMLP-1 proteins with such post-translational modifications.

As noted earlier, host cells can be prokaryotic or eukaryotic.

Representative examples of appropriate host cells include, but are not limited to, bacterial cells, such as *E. coli, Caulobacter crescentus*, Streptomyces species, and *Salmonella typhimurium*; yeast cells, such as *Saccharomyces cerevisiae, Schizosaccharomyces pombe, Pichia pastoris, Pichia methanolica*; insect cell lines, such as those from *Spodoptera frugiperda*—e.g., Sf9 and Sf21 cell lines, and expresSF™ cells (Protein Sciences Corp., Meriden, Conn., USA)—Drosophila S2 cells, and Trichoplusia ni High Five® Cells (Invitrogen, Carlsbad, Calif., USA); and mammalian cells. Typical mammalian cells include COS1 and COS7 cells, chinese hamster ovary (CHO) cells, NIH 3T3 cells, 293 cells, HEPG2 cells, HeLa cells, L cells, HeLa, MDCK, HEK293, WI38, murine ES cell lines (e.g., from strains 129/SV, C57/BL6, DBA-1, 129/SVJ), K562, Jurkat cells, and BW5147. Other mammalian cell lines are well known and readily available from the American Type Culture Collection (ATCC) (Manassas, Va., USA) and the National Institute of General medical Sciences (NIGMS) Human Genetic Cell Repository at the Coriell Cell Repositories (Camden, N.J., USA).

Methods for introducing the vectors and nucleic acids of the present invention into the host cells are well known in the art; the choice of technique will depend primarily upon the specific vector to be introduced and the host cell chosen.

For example, phage lambda vectors will typically be packaged using a packaging extract (e.g., Gigapack® packaging extract, Stratagene, La Jolla, Calif., USA), and the packaged virus used to infect *E. coli*. Plasmid vectors will typically be introduced into chemically competent or electrocompetent bacterial cells.

*E. coli* cells can be rendered chemically competent by treatment, e.g., with $CaCl_2$, or a solution of $Mg^{2+}$, $Mn^{2+}$, $Ca^{2+}$, $Rb^+$ or $K^+$, dimethyl sulfoxide, dithiothreitol, and hexamine cobalt (III), Hanahan, *J. Mol. Biol.* 166(4):557–80 (1983), and vectors introduced by heat shock. A wide variety of chemically competent strains are also available commercially (e.g., Epicurian Coli® XL10-Gold® Ultracompetent Cells (Stratagene, La Jolla, Calif., USA); DH5α competent cells (Clontech Laboratories, Palo Alto, Calif., USA); TOP10 Chemically Competent *E. coli* Kit (Invitrogen, Carlsbad, Calif., USA)).

Bacterial cells can be rendered electrocompetent—that is, competent to take up exogenous DNA by electroporation—by various pre-pulse treatments; vectors are introduced by electroporation followed by subsequent outgrowth in selected media. An extensive series of protocols is provided online in *Electroprotocols Online: Collection of Protocols for Gene Transfer* (Bulletin #1029735, BioRad, Richmond, Calif., USA).

Vectors can be introduced into yeast cells by spheroplasting, treatment with lithium salts, electroporation, or protoplast fusion.

Spheroplasts are prepared by the action of hydrolytic enzymes—a snail-gut extract, usually denoted Glusulase, or Zymolyase, an enzyme from *Arthrobacter luteus*—to remove portions of the cell wall in the presence of osmotic stabilizers, typically 1 M sorbitol. DNA is added to the spheroplasts, and the mixture is co-precipitated with a solution of polyethylene glycol (PEG) and $Ca^{2+}$. Subsequently, the cells are resuspended in a solution of sorbitol, mixed with molten agar and then layered on the surface of a selective plate containing sorbitol. For lithium-mediated transformation, yeast cells are treated with lithium acetate, which apparently permeabilizes the cell wall, DNA is added and the cells are co-precipitated with PEG. The cells are exposed to a brief heat shock, washed free of PEG and lithium acetate, and subsequently spread on plates containing ordinary selective medium. Increased frequencies of transformation are obtained by using specially-prepared single-stranded carrier DNA and certain organic solvents. Schiestl et al., *Curr. Genet.* 16(5–6):339–46 (1989). For electroporation, freshly-grown yeast cultures are typically washed, suspended in an osmotic protectant, such as sorbitol, mixed with DNA, and the cell suspension pulsed in an electroporation device. Subsequently, the cells are spread on the surface of plates containing selective media. Becker et al., *Methods Enzymol.* 194:182–7 (1991). The efficiency of transformation by electroporation can be increased over 100-fold by using PEG, single-stranded carrier DNA and cells that are in late log-phase of growth. Larger constructs, such as YACs, can be introduced by protoplast fusion.

Mammalian and insect cells can be directly infected by packaged viral vectors, or transfected by chemical or electrical means.

For chemical transfection, DNA can be coprecipitated with $CaPO_4$ or introduced using liposomal and nonliposomal lipid-based agents. Commercial kits are available for $CaPO_4$ transfection (CalPhos™ Mammalian Transfection Kit, Clontech Laboratories, Palo Alto, Calif., USA), and lipid-mediated transfection can be practiced using commercial reagents, such as LIPOFECTAMINE™ 2000, LIPO-FECTAMINE™ Reagent, CELLFECTIN® Reagent, and LIPOFECTIN® Reagent (Invitrogen, Carlsbad, Calif., USA), DOTAP Liposomal Transfection Reagent, FuGENE 6, X-tremeGENE Q2, DOSPER, (Roche Molecular Biochemicals, Indianapolis, Ind. USA), Effectene™, PolyFect®, Superfect® (Qiagen, Inc., Valencia, Calif., USA). Protocols for electroporating mammalian cells can be found online in *Electroprotocols Online: Collection of Protocols for Gene Transfer* (Bulletin #1029735, BioRad, Richmond, Calif., USA). See also, Norton et al. (eds.), *Gene Transfer Methods: Introducing DNA into Living Cells and Organisms*, BioTechniques Books, Eaton Publishing Co. (2000) (ISBN 1-881299-34-1), incorporated herein by reference in its entirety.

Other transfection techniques include transfection by particle embardment. See, e.g., Cheng et al., *Proc. Natl. Acad. Sci. USA* 90(10):4455–9 (1993); Yang et al., *Proc. Natl. Acad. Sci. USA* 87(24):9568–72 (1990).

Proteins

In another aspect, the present invention provides hGDMLP-1 proteins, various fragments thereof suitable for use as antigens (e.g., for epitope mapping) and for use as immunogens (e.g., for raising antibodies or as vaccines), fusions of hGDMLP-1 polypeptides and fragments to heterologous polypeptides, and conjugates of the proteins, fragments, and fusions of the present invention to other moieties (e.g., to carrier proteins, to fluorophores).

FIG. 2 presents the predicted amino acid sequence encoded by the hGDMLP-1cDNA clone. The amino acid sequence is further presented, respectively, in the Sequence Listing.

Unless otherwise indicated, amino acid sequences of the proteins of the present invention were determined as a predicted translation from a nucleic acid sequence. Accordingly, any amino acid sequence presented herein may contain errors due to errors in the nucleic acid sequence, as described in detail above. Furthermore, single nucleotide polymorphisms (SNPs) occur frequently in eukaryotic genomes—more than 1.4 million SNPs have already been identified in the human genome, International Human Genome Sequencing Consortium, *Nature* 409:860–921 (2001)—and the sequence determined from one individual of a species may differ from other allelic forms present within the population. Small deletions and insertions can often be found that do not alter the function of the protein.

Accordingly, it is an aspect of the present invention to provide proteins not only identical in sequence to those described with particularity herein, but also to provide isolated proteins at least about 65% identical in sequence to those described with particularity herein, typically at least about 70%, 75%, 80%, 85%, or 90% identical in sequence to those described with particularity herein, usefully at least about 91%, 92%, 93%, 94%, or 95% identical in sequence to those described with particularity herein, usefully at least about 96%, 97%, 98%, or 99% identical in sequence to those described with particularity herein, and, most conservatively, at least about 99.5%, 99.6%, 99.7%, 99.8% and 99.9% identical in sequence to those described with particularity herein. These sequence variants can be naturally occurring or can result from human intervention by way of random or directed mutagenesis.

For purposes herein, percent identity of two amino acid sequences is determined using the procedure of Tatiana et al., "Blast 2 sequences—a new tool for comparing protein and nucleotide sequences", FEMS *Microbiol Lett.* 174:247–250 (1999), which procedure is effectuated by the computer program BLAST 2 SEQUENCES, available online at the National Center for Biotechnology Information (NCBI) website. To assess percent identity of amino acid sequences, the BLASTP module of BLAST 2 SEQUENCES is used with default values of (i) BLOSUM62 matrix, Henikoff et al., *Proc. Nati. Acad. Sd USA* 89(22):10915–9 (1992); (ii) open gap 11 and extension gap 1 penalties; and (iii) gap x_dropoff 50 expect 10 word size 3 filter, and both sequences are entered in their entireties.

As is well known, amino acid substitutions occur frequently among natural allelic variants, with conservative substitutions often occasioning only de minimis change in protein function.

Accordingly, it is an aspect of the present invention to provide proteins not only identical in sequence to those described with particularity herein, but also to provide isolated proteins having the sequence of hGDMLP-1 proteins, or portions thereof, with conservative amino acid substitutions. It is a further aspect to provide isolated proteins having the sequence of hGDMLP-1 proteins, and portions thereof, with moderately conservative amino acid substitutions. These conservatively-substituted or moderately conservatively-substituted variants can be naturally occurring or can result from human intervention.

Although there are a variety of metrics for calling conservative amino acid substitutions, based primarily on either observed changes among evolutionarily related proteins or on predicted chemical similarity, for purposes herein a conservative replacement is any change having a positive value in the PAM250 log-likelihood matrix reproduced herein below (see Gonnet et al., *Science* 256(5062):1443–5 (1992)):

such as chimpanzee, rhesus macaque monkey, baboon, orangutan, and gorilla; from rodents, such as rats, mice, guinea pigs; from lagomorphs, such as rabbits, and from domestic livestock, such as cow, pig, sheep, horse, goat.

Relatedness of proteins can also be characterized using a second functional test, the ability of a first protein competitively to inhibit the binding of a second protein to an antibody.

It is, therefore, another aspect of the present invention to provide isolated proteins not only identical in sequence to those described with particularity herein, but also to provide isolated proteins ("cross-reactive proteins") that competitively inhibit the binding of antibodies to all or to a portion of various of the isolated hGDMLP-1 proteins of the present invention ("reference proteins"). Such competitive inhibition can readily be determined using immunoassays well known in the art.

Among the proteins of the present invention that differ in amino acid sequence from those described with particularity

|   | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 2 | -1 | 0 | 0 | 0 | 0 | 0 | 0 | -1 | -1 | -1 | 0 | -1 | -2 | 0 | 1 | 1 | -4 | -2 | 0 |
| R | -1 | 5 | 0 | 0 | -2 | 2 | 0 | -1 | 1 | -2 | -2 | 3 | -2 | -3 | -1 | 0 | 0 | -2 | -2 | -2 |
| N | 0 | 0 | 4 | 2 | -2 | 1 | 1 | 0 | 1 | -3 | -3 | 1 | -2 | -3 | -1 | 1 | 0 | -4 | -1 | -2 |
| D | 0 | 0 | 2 | 5 | -3 | 1 | 3 | 0 | 0 | -4 | -4 | 0 | -3 | -4 | -1 | 0 | 0 | -5 | -3 | -3 |
| C | 0 | -2 | -2 | -3 | 12 | -2 | -3 | -2 | -1 | -1 | -2 | -3 | -1 | -1 | -3 | 0 | 0 | -1 | 0 | 0 |
| Q | 0 | 2 | 1 | 1 | -2 | 3 | 2 | -1 | 1 | -2 | -2 | 2 | -1 | -3 | 0 | 0 | 0 | -3 | -2 | -2 |
| E | 0 | 0 | 1 | 3 | -3 | 2 | 4 | -1 | 0 | -3 | -3 | 1 | -2 | -4 | 0 | 0 | 0 | -4 | -3 | -2 |
| G | 0 | -1 | 0 | 0 | -2 | -1 | -1 | 7 | -1 | -4 | -4 | -1 | -4 | -5 | -2 | 0 | -1 | -4 | -4 | -3 |
| H | -1 | 1 | 1 | 0 | -1 | 1 | 0 | -1 | 6 | -2 | -2 | 1 | -1 | 0 | -1 | 0 | 0 | -1 | 2 | -2 |
| I | -1 | -2 | -3 | -4 | -1 | -2 | -3 | -4 | -2 | 4 | 3 | -2 | 2 | 1 | -3 | -2 | -1 | -2 | -1 | 3 |
| L | -1 | -2 | -3 | -4 | -2 | -2 | -3 | -4 | -2 | 3 | 4 | -2 | 3 | 2 | -2 | -2 | -1 | -1 | 0 | 2 |
| K | 0 | 3 | 1 | 0 | -3 | 2 | 1 | -1 | 1 | -2 | -2 | 3 | -1 | -3 | -1 | 0 | 0 | -4 | -2 | -2 |
| M | -1 | -2 | -2 | -3 | -1 | -1 | -2 | -4 | -1 | 2 | 3 | -1 | 4 | 2 | -2 | -1 | -1 | -1 | 0 | 2 |
| F | -2 | -3 | -3 | -4 | -1 | -3 | -4 | -5 | 0 | 1 | 2 | -3 | 2 | 7 | -4 | -3 | -2 | 4 | 5 | 0 |
| P | 0 | -1 | -1 | -1 | -3 | 0 | 0 | -2 | -1 | -3 | -2 | -1 | -2 | -4 | 8 | 0 | 0 | -5 | -3 | -2 |
| S | 1 | 0 | 1 | 0 | 0 | 0 | 0 | 0 | 0 | -2 | -2 | 0 | -1 | -3 | 0 | 2 | 2 | -3 | -2 | -1 |
| T | 1 | 0 | 0 | 0 | 0 | 0 | 0 | -1 | 0 | -1 | -1 | 0 | -1 | -2 | 0 | 2 | 2 | -4 | -2 | 0 |
| W | -4 | -2 | -3 | -5 | -1 | -3 | -4 | -4 | -1 | -2 | -1 | -4 | -1 | 4 | -5 | -3 | -4 | 14 | 4 | -3 |
| Y | -2 | -2 | -1 | -3 | 0 | -2 | -3 | -4 | 2 | -1 | 0 | -2 | 0 | 5 | -3 | -2 | -2 | 4 | 8 | -1 |
| V | 0 | -2 | -2 | -3 | 0 | -2 | -2 | -3 | -2 | 3 | 2 | -2 | 2 | 0 | -2 | -1 | 0 | -3 | -1 | 3 |

For purposes herein, a "moderately conservative" replacement is any change having a nonnegative value in the PAM250 log-likelihood matrix reproduced herein above.

As is also well known in the art, relatedness of proteins can also be characterized using a functional test, the ability of the encoding nucleic acids to base-pair to one another at defined hybridization stringencies.

It is, therefore, another aspect of the invention to provide isolated proteins not only identical in sequence to those described with particularity herein, but also to provide isolated proteins ("hybridization related proteins") that are encoded by nucleic acids that hybridize under high stringency conditions (as defined herein above) to all or to a portion of various of the isolated nucleic acids of the present invention ("reference nucleic acids"). It is a further aspect of the invention to provide isolated proteins ("hybridization related proteins") that are encoded by nucleic acids that hybridize under moderate stringency conditions (as defined herein above) to all or to a portion of various of the isolated nucleic acids of the present invention ("reference nucleic acids").

The hybridization related proteins can be alternative isoforms, homologues, paralogues, and orthologues of the hGDMLP-1 protein of the present invention. Particularly useful orthologues are those from other primate species, herein—including those that have deletions and insertions causing up to 10% non-identity, those having conservative or moderately conservative substitutions, hybridization related proteins, and cross-reactive proteins—those that are biologically active, i.e., that retain at least one structural, regulatory, or biological or biochemical activity of hGDMLP-1. As described above, and further described in Example 1, below, those activities include ATPase activity, actin-binding, calmodulin binding, possession of an IQ domain, and possession of a myosin heavy chain-like tail.

Residues that are tolerant of change while retaining function can be identified by altering the protein at known residues using methods known in the art, such as alanine scanning mutagenesis, Cunningham et al., *Science* 244 (4908):1081–5 (1989); transposon linker scanning mutagenesis, Chen et al., *Gene* 263(1–2):39–48 (2001); combinations of homolog- and alanine-scanning mutagenesis, Jin et al., *J. Mol. Biol.* 226(3):851–65 (1992); combinatorial alanine scanning, Weiss et al., *Proc. Natl. Acad. Sci USA* 97(16):8950–4 (2000), followed by functional assay. Transposon linker scanning kits are available commercially (New England Biolabs, Beverly, Mass., USA, catalog. no. E7–102S; EZ::TN™ In-Frame Linker Insertion Kit, catalogue no. EZI04KN, Epicentre Technologies Corporation, Madison, Wis., USA).

As further described below, the isolated proteins of the present invention can readily be used as specific immunogens to raise antibodies that specifically recognize hGDMLP-1 proteins, their isoforms, homologues, paralogues, and/or orthologues. The antibodies, in turn, can be used, inter alia, specifically to assay for the hGDMLP-1 proteins of the present invention—e.g. by ELISA for detection of protein fluid samples, such as serum, by immunohistochemistry or laser scanning cytometry, for detection of protein in tissue samples, or by flow cytometry, for detection of intracellular protein in cell suspensions—for specific antibody-mediated isolation and/or purification of hGDMLP-1 proteins, as for example by immunoprecipitation, and for use as specific agonists or antagonists of hGDMLP-1 action.

The isolated proteins of the present invention are also immediately available for use as specific standards in assays used to determine the concentration and/or amount specifically of the hGDMLP-1 proteins of the present invention. As is well known, ELISA kits for detection and quantitation of protein analytes typically include isolated and purified protein of known concentration for use as a measurement standard (e.g., the human interferon-γ OptEIA kit, catalog no. 555142, Pharmingen, San Diego, Calif., USA includes human recombinant gamma interferon, baculovirus produced).

The isolated proteins of the present invention are also immediately available for use as specific biomolecule capture probes for surface-enhanced laser desorption ionization (SELDI) detection of protein—protein interactions, WO 98/59362; WO 98/59360; WO 98/59361; and Merchant et al., *Electrophoresis* 21(6):1164–77 (2000), the disclosures of which are incorporated herein by reference in their entireties. Analogously, the isolated proteins of the present invention are also immediately available for use as specific biomolecule capture probes on BIACORE surface plasmon resonance probes. See Weinberger et al., *Pharmacogenomics* 1(4):395–416 (2000); Malmqvist, Biochem. Soc. Trans. 27(2):335–40 (1999).

The isolated proteins of the present invention are also useful as a therapeutic supplement in patients having a specific deficiency in hGDMLP-1 production.

In another aspect, the invention also provides fragments of various of the proteins of the present invention. The protein fragments are useful, inter alia, as antigenic and immunogenic fragments of hGDMLP-1.

By "fragments" of a protein is here intended isolated proteins (equally, polypeptides, peptides, oligopeptides), however obtained, that have an amino acid sequence identical to a portion of the reference amino acid sequence, which portion is at least 6 amino acids and less than the entirety of the reference nucleic acid. As so defined, "fragments" need not be obtained by physical fragmentation of the reference protein, although such provenance is not thereby precluded.

Fragments of at least 6 contiguous amino acids are useful in mapping B cell and T cell epitopes of the reference protein. See, e.g., Geysen et al., "Use of peptide synthesis to probe viral antigens for epitopes to a resolution of a single amino acid," *Proc. Natl. Acad. Sci. USA* 81:3998–4002 (1984) and U.S. Pat. Nos. 4,708,871 and 5,595,915, the disclosures of which are incorporated herein by reference in their entireties. Because the fragment need not itself be immunogenic, part of an immunodominant epitope, nor even recognized by native antibody, to be useful in such epitope mapping, all fragments of at least 6 amino acids of the proteins of the present invention have utility in such a study.

Fragments of at least 8 contiguous amino acids, often at least 15 contiguous amino acids, have utility as immunogens for raising antibodies that recognize the proteins of the present invention. See, e.g., Lerner, "Tapping the immunological repertoire to produce antibodies of predetermined specificity," Nature 299:592–596 (1982); Shinnick et al., "Synthetic peptide immunogens as vaccines," *Annu. Rev. Microbiol.* 37:425–46 (1983); Sutcliffe et al., "Antibodies that react with predetermined sites on proteins," *Science* 219:660–6 (1983), the disclosures of which are incorporated herein by reference in their entireties. As further described in the above-cited references, virtually all 8-mers, conjugated to a carrier, such as a protein, prove immunogenic—that is, prove capable of eliciting antibody for the conjugated peptide; accordingly, all fragments of at least 8 amino acids of the proteins of the present invention have utility as immunogens.

Fragments of at least 8, 9, 10 or 12 contiguous amino acids are also useful as competitive inhibitors of binding of the entire protein, or a portion thereof, to antibodies (as in epitope mapping), and to natural binding partners, such as subunits in a multimeric complex or to receptors or ligands of the subject protein; this competitive inhibition permits identification and separation of molecules that bind specifically to the protein of interest, U.S. Pat. Nos. 5,539,084 and 5,783,674, incorporated herein by reference in their entireties.

The protein, or protein fragment, of the present invention is thus at least 6 amino acids in length, typically at least 8, 9, 10 or 12 amino acids in length, and often at least 15 amino acids in length. Often, the protein or the present invention, or fragment thereof, is at least 20 amino acids in length, even 25 amino acids, 30 amino acids, 35 amino acids, or 50 amino acids or more in length. Of course, larger fragments having at least 75 amino acids, 100 amino acids, or even 150 amino acids are also useful, and at times preferred.

The present invention further provides fusions of each of the proteins and protein fragments of the present invention to heterologous polypeptides.

By fusion is here intended that the protein or protein fragment of the present invention is linearly contiguous to the heterologous polypeptide in a peptide-bonded polymer of amino acids or amino acid analogues; by "heterologous polypeptide" is here intended a polypeptide that does not naturally occur in contiguity with the protein or protein fragment of the present invention. As so defined, the fusion can consist entirely of a plurality of fragments of the hGDMLP-1 protein in altered arrangement; in such case, any of the hGDMLP-1 fragments can be considered heterologous to the other hGDMLP-1 fragments in the fusion protein. More typically, however, the heterologous polypeptide is not drawn from the hGDMLP-1 protein itself.

The fusion proteins of the present invention will include at least one fragment of the protein of the present invention, which fragment is at least 6, typically at least 8, often at least 15, and usefully at least 16, 17, 18, 19, or 20 amino acids long. The fragment of the protein of the present to be included in the fusion can usefully be at least 25 amino acids long, at least 50 amino acids long, and can be at least 75, 100, or even 150 amino acids long. Fusions that include the entirety of the proteins of the present invention have particular utility.

The heterologous polypeptide included within the fusion protein of the present invention is at least 6 amino acids in length, often at least 8 amino acids in length, and usefully at least 15, 20, and 25 amino acids in length. Fusions that include larger polypeptides, such as the IgG Fc region, and even entire proteins (such as GFP chromophore-containing proteins), have particular utility.

As described above in the description of vectors and expression vectors of the present invention, which discussion is incorporated here by reference in its entirety, heterologous polypeptides to be included in the fusion proteins of the present invention can usefully include those designed to facilitate purification and/or visualization of recombinantly-expressed proteins. Although purification tags can also be incorporated into fusions that are chemically synthesized, chemical synthesis typically provides sufficient purity that further purification by HPLC suffices; however, visualization tags as above described retain their utility even when the protein is produced by chemical synthesis, and when so included render the fusion proteins of the present invention useful as directly detectable markers of hGDMLP-1 presence.

As also discussed above, heterologous polypeptides to be included in the fusion proteins of the present invention can usefully include those that facilitate secretion of recombinantly expressed proteins—into the periplasmic space or extracellular milieu for prokaryotic hosts, into the culture medium for eukaryotic cells—through incorporation of secretion signals and/or leader sequences.

Other useful protein fusions of the present invention include those that permit use of the protein of the present invention as bait in a yeast two-hybrid system. See Bartel et al. (eds.), *The Yeast Two-Hybrid System*, Oxford University Press (1997) (ISBN: 0195109384); Zhu et al., *Yeast Hybrid Technologies*, Eaton Publishing, (2000) (ISBN 1-881299-15-5); Fields et al., *Trends Genet.* 10(8):286–92 (1994); Mendelsohn et al., *Curr. Opin. Biotechnol.* S(5):482–6 (1994); Luban et al., *Curr. Opin. Biotechnol.* 6(1):59–64 (1995); Allen et al., Trends Biochem. Sci. 20(12):511–6 (1995); Drees, *Curr. Opin. Chem. Biol.* 3(1):64–70 (1999); Topcu et al., *Pharm. Res.* 17(9):1049–55 (2000); Fashena et al., Gene 250(1–2):1–14 (2000), the disclosures of which are incorporated herein by reference in their entireties. Typically, such fusion is to either *E. coli* LexA or yeast GAL4 DNA binding domains. Related bait plasmids are available that express the bait fused to a nuclear localization signal.

Other useful protein fusions include those that permit display of the encoded protein on the surface of a phage or cell, fusions to intrinsically fluorescent proteins, such as green fluorescent protein (GFP), and fusions to the IgG Fc region, as described above, which discussion is incorporated here by reference in its entirety.

The proteins and protein fragments of the present invention can also usefully be fused to protein toxins, such as Pseudomonas exotoxin A, diphtheria toxin, shiga toxin A, anthrax toxin lethal factor, ricin, in order to effect ablation of cells that bind or take up the proteins of the present invention.

The isolated proteins, protein fragments, and protein fusions of the present invention can be composed of natural amino acids linked by native peptide bonds, or can contain any or all of nonnatural amino acid analogues, nonnative bonds, and post-synthetic (post translational) modifications, either throughout the length of the protein or localized to one or more portions thereof.

As is well known in the art, when the isolated protein is used, e.g., for epitope mapping, the range of such nonnatural analogues, nonnative inter-residue bonds, or post-synthesis modifications will be limited to those that permit binding of the peptide to antibodies. When used as an immunogen for the preparation of antibodies in a non-human host, such as a mouse, the range of such nonnatural analogues, nonnative inter-residue bonds, or post-synthesis modifications will be limited to those that do not interfere with the immunogenicity of the protein. When the isolated protein is used as a therapeutic agent, such as a vaccine or for replacement therapy, the range of such changes will be limited to those that do not confer toxicity upon the isolated protein.

Non-natural amino acids can be incorporated during solid phase chemical synthesis or by recombinant techniques, although the former is typically more common.

Solid phase chemical synthesis of peptides is well established in the art. Procedures are described, inter alia, in Chan et al. (eds.), *Fmoc Solid Phase Peptide Synthesis: A Practical Approach* (Practical Approach Series), Oxford Univ. Press (March 2000) (ISBN: 0199637245); Jones, *Amino Acid and Peptide Synthesis* (Oxford Chemistry Primers, No 7), Oxford Univ. Press (August 1992) (ISBN: 0198556683); and Bodanszky, *Principles of Peptide Synthesis* (Springer Laboratory), Springer Verlag (December 1993) (ISBN: 0387564314), the disclosures of which are incorporated herein by reference in their entireties.

Non-natural amino acids can be incorporated during solid phase chemical synthesis.

For example, D-enantiomers of natural amino acids can readily be incorporated during chemical peptide synthesis: peptides assembled from D-amino acids are more resistant to proteolytic attack; incorporation of D-enantiomers can also be used to confer specific three dimensional conformations on the peptide. Other amino acid analogues commonly added during chemical synthesis include ornithine, norleucine, phosphorylated amino acids (typically phosphoserine, phosphothreonine, phosphotyrosine), L-malonyltyrosine, a non-hydrolyzable analog of phosphotyrosine (Kole et al., *Biochem. Biophys. Res. Com.* 209:817–821 (1995)), and various halogenated phenylalanine derivatives.

Amino acid analogues having detectable labels are also usefully incorporated during synthesis to provide a labeled polypeptide.

Biotin, for example can be added using biotinoyl—(9-fluorenylmethoxycarbonyl)-L-lysine (FMOC biocytin) (Molecular Probes, Eugene, Oreg., USA). (Biotin can also be added enzymatically by incorporation into a fusion protein of a *E. coli* BirA substrate peptide.)

The FMOC and tBOC derivatives of dabcyl-L-lysine (Molecular Probes, Inc., Eugene, Oreg., USA) can be used to incorporate the dabcyl chromophore at selected sites in the peptide sequence during synthesis. The aminonaphthalene derivative EDANS, the most common fluorophore for pairing with the dabcyl quencher in fluorescence resonance energy transfer (FRET) systems, can be introduced during automated synthesis of peptides by using EDANS—FMOC-L-glutamic acid or the corresponding tBOC derivative (both from Molecular Probes, Inc., Eugene, Oreg., USA). Tetramethylrhodamine fluorophores can be incorporated during automated FMOC synthesis of peptides using (FMOC)—TMR-L-lysine (Molecular Probes, Inc. Eugene, Oreg., USA).

Other useful amino acid analogues that can be incorporated during chemical synthesis include aspartic acid, glutamic acid, lysine, and tyrosine analogues having allyl side-chain protection (Applied Biosystems, Inc., Foster City, Calif., USA); the allyl side chain permits synthesis of cyclic, branched-chain, sulfonated, glycosylated, and phosphorylated peptides.

A large number of other FMOC-protected non-natural amino acid analogues capable of incorporation during chemical synthesis are available commercially, including, e.g., Fmoc-2-aminobicyclo[2.2.1]heptane-2-carboxylic acid, Fmoc-3-endo-aminobicyclo[2.2.1]heptane-2-endo-carboxylic acid, Fmoc-3-exo-aminobicyclo[2.2.1]heptane-2-exo-carboxylic acid, Fmoc-3-endo-amino-bicyclo[2.2.1] hept-5-ene-2-endo-carboxylic acid, Fmoc-3-exo-amino-bicyclo[2.2.1]hept-5-ene-2-exo-carboxylic acid, Fmoc-cis-2-amino-1-cyclohexanecarboxylic acid, Fmoc-trans-2-amino-1-cyclohexanecarboxylic acid, Fmoc-1-amino-1-cyclopentanecarboxylic acid, Fmoc-cis-2-amino-1-cyclopentanecarboxylic acid, Fmoc-1-amino-1-cyclopropanecarboxylic acid, Fmoc-D-2-amino-4-(ethylthio)butyric acid, Fmoc-L-2-amino-4-(ethylthio) butyric acid, Fmoc-L-buthionine, Fmoc-S-methyl-L-Cysteine, Fmoc-2-aminobenzoic acid (anthranillic acid), Fmoc-3-aminobenzoic acid, Fmoc-4-aminobenzoic acid, Fmoc-2-aminobenzophenone-2'-carboxylic acid, Fmoc-N-(4-aminobenzoyl)-b-alanine, Fmoc-2-amino-4,5-dimethoxybenzoic acid, Fmoc-4-aminohippuric acid, Fmoc-2-amino-3-hydroxybenzoic acid, Fmoc-2-amino-5-hydroxybenzoic acid, Fmoc-3-amino-4-hydroxybenzoic acid, Fmoc-4-amino-3-hydroxybenzoic acid, Fmoc-4-amino-2-hydroxybenzoic acid, Fmoc-5-amino-2-hydroxybenzoic acid, Fmoc-2-amino-3-methoxybenzoic acid, Fmoc-4-amino-3-methoxybenzoic acid, Fmoc-2-amino-3-methylbenzoic acid, Fmoc-2-amino-5-methylbenzoic acid, Fmoc-2-amino-6-methylbenzoic acid, Fmoc-3-amino-2-methylbenzoic acid, Fmoc-3-amino-4-methylbenzoic acid, Fmoc-4-amino-3-methylbenzoic acid, Fmoc-3-amino-2-naphtoic acid, Fmoc-D,L-3-amino-3-phenylpropionic acid, Fmoc-L-Methyldopa, Fmoc-2-amino-4,6-dimethyl-3-pyridinecarboxylic acid, Fmoc-D,L-?-amino-2-thiophenacetic acid, Fmoc-4-(carboxymethyl) piperazine, Fmoc-4-carboxypiperazine, Fmoc-4-(carboxymethyl)homopiperazine, Fmoc-4-phenyl-4-piperidinecarboxylic acid, Fmoc-L-1,2,3,4-tetrahydronorharman-3-carboxylic acid, Fmoc-L-thiazolidine-4-carboxylic acid, all available from The Peptide Laboratory (Richmond, Calif., USA).

Non-natural residues can also be added biosynthetically by engineering a suppressor tRNA, typically one that recognizes the UAG stop codon, by chemical aminoacylation with the desired unnatural amino acid and. Conventional site-directed mutagenesis is used to introduce the chosen stop codon UAG at the site of interest in the protein gene. When the acylated suppressor tRNA and the mutant gene are combined in an in vitro transcription/translation system, the unnatural amino acid is incorporated in response to the UAG codon to give a protein containing that amino acid at the specified position. Liu et al., *Proc. Natl Acad. Sci. USA* 96(9):4780–5 (1999); Wang et al., *Science* 292(5516):498–500 (2001).

The isolated proteins, protein fragments and fusion proteins of the present invention can also include nonnative inter-residue bonds, including bonds that lead to circular and branched forms.

The isolated proteins and protein fragments of the present invention can also include post-translational and post-synthetic modifications, either throughout the length of the protein or localized to one or more portions thereof.

For example, when produced by recombinant expression in eukaryotic cells, the isolated proteins, fragments, and fusion proteins of the present invention will typically include N-linked and/or 0-linked glycosylation, the pattern of which will reflect both the availability of glycosylation sites on the protein sequence and the identity of the host cell. Further modification of glycosylation pattern can be performed enzymatically.

As another example, recombinant polypeptides of the invention can also include an initial modified methionine residue, in some cases resulting from host-mediated processes.

When the proteins, protein fragments, and protein fusions of the present invention are produced by chemical synthesis, post-synthetic modification can be performed before deprotection and cleavage from the resin or after deprotection and cleavage. Modification before deprotection and cleavage of the synthesized protein often allows greater control, e.g. by allowing targeting of the modifying moiety to the N-terminus of a resin-bound synthetic peptide.

Useful post-synthetic (and post-translational) modifications include conjugation to detectable labels, such as fluorophores.

A wide variety of amine-reactive and thiol-reactive fluorophore derivatives have been synthesized that react under nondenaturing conditions with N-terminal amino groups and epsilon amino groups of lysine residues, on the one hand, and with free thiol groups of cysteine residues, on the other.

Kits are available commercially that permit conjugation of proteins to a variety of amine-reactive or thiol-reactive fluorophores: Molecular Probes, Inc. (Eugene, Oreg., USA), e.g., offers kits for conjugating proteins to Alexa Fluor 350, Alexa Fluor 430, Fluorescein-EX, Alexa Fluor 488, Oregon Green 488, Alexa Fluor 532, Alexa Fluor 546, Alexa Fluor 546, Alexa Fluor 568, Alexa Fluor 594, and Texas Red-X.

A wide variety of other amine-reactive and thiol-reactive fluorophores are available commercially (Molecular Probes, Inc., Eugene, Oreg., USA), including Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA).

The polypeptides of the present invention can also be conjugated to fluorophores, other proteins, and other macromolecules, using bifunctional linking reagents.

Common homobifunctional reagents include, e.g., APG, AEDP, BASED, BMB, BMDB, BMH, BMOE, BM[PEO]3, BM[PEO]4, BS3, BSOCOES, DFDNB, DMA, DMP, DMS, DPDPB, DSG, DSP (Lomant's Reagent), DSS, DST, DTBP, DTME, DTSSP, EGS, HBVS, Sulfo-BSOCOES, Sulfo-DST, Sulfo-EGS (all available from Pierce, Rockford, Ill., USA); common heterobifunctional cross-linkers include ABH, AMAS, ANB-NOS, APDP, ASBA, BMPA, BMPH, BMPS, EDC, EMCA, EMCH, EMCS, KMUA, KMUH, GMBS, LC-SMCC, LC-SPDP, MBS, M2C2H, MPBH, MSA, NHS-ASA, PDPH, PMPI, SADP, SAED, SAND, SANPAH, SASD, SATP, SBAP, SFAD, SIA, SIAB, SMCC, SMPB, SMPH, SMPT, SPDP, Sulfo-EMCS, Sulfo-GMBS, Sulfo-HSAB, Sulfo-KMUS, Sulfo-LC-SPDP, Sulfo-MBS, Sulfo-NHS-LC-ASA, Sulfo-SADP, Sulfo-SANPAH, Sulfo-SIAB, Sulfo-SMCC, Sulfo-SMPB, Sulfo-LC-SMPT, SVSB, TFCS (all available Pierce, Rockford, Ill., USA).

The proteins, protein fragments, and protein fusions of the present invention can be conjugated, using such cross-linking reagents, to fluorophores that are not amine- or thiol-reactive.

Other labels that usefully can be conjugated to the proteins, protein fragments, and fusion proteins of the present invention include radioactive labels, echosonographic contrast reagents, and MRI contrast agents.

The proteins, protein fragments, and protein fusions of the present invention can also usefully be conjugated using cross-linking agents to carrier proteins, such as KLH, bovine thyroglobulin, and even bovine serum albumin (BSA), to increase immunogenicity for raising anti-hGDMLP-lantibodies.

The proteins, protein fragments, and protein fusions of the present invention can also usefully be conjugated to polyethylene glycol (PEG); PEGylation increases the serum half life of proteins administered intravenously for replacement therapy. Delgado et al., *Crit. Rev. Ther. Drug Carrier Syst.* 9(3–4):249–304 (1992); Scott et al., *Curr. Pharm. Des.* 4(6):423–38 (1998); DeSantis et al., *Curr. Opin. Biotechnol.* 10(4):324–30 (1999), incorporated herein by reference in their entireties. PEG monomers can be attached to the protein directly or through a linker, with PEGylation using PEG monomers activated with tresyl chloride (2,2,2-trifluoroethanesulphonyl chloride) permitting direct attachment under mild conditions.

The isolated proteins of the present invention, including fusions thereof, can be produced by recombinant expression, typically using the expression vectors of the present invention as above-described or, if fewer than about 100 amino acids, by chemical synthesis (typically, solid phase synthesis), and, on occasion, by in vitro translation.

Production of the isolated proteins of the present invention can optionally be followed by purification.

Purification of recombinantly expressed proteins is now well within the skill in the art. See, e.g., Thorner et al. (eds.), *Applications of Chimeric Genes and Hybrid Proteins, Part A: Gene Expression and Protein Purification* (Methods in Enzymology, Volume 326), Academic Press (2000), (ISBN: 0121822273); Harbin (ed.), *Cloning, Gene Expression and Protein Purification: Experimental Procedures and Process Rationale*, Oxford Univ. Press (2001) (ISBN: 0195132947); Marshak et al., *Strategies for Protein Purification and Characterization: A Laboratory Course Manual*, Cold Spring Harbor Laboratory Press (1996) (ISBN: 0-87969-385-1); and Roe (ed.), *Protein Purification Applications*, Oxford University Press (2001), the disclosures of which are incorporated herein by reference in their entireties, and thus need not be detailed here.

Briefly, however, if purification tags have been fused through use of an expression vector that appends such tag, purification can be effected, at least in part, by means appropriate to the tag, such as use of immobilized metal affinity chromatography for polyhistidine tags. Other techniques common in the art include ammonium sulfate fractionation, immunoprecipitation, fast protein liquid chromatography (FPLC), high performance liquid chromatography (HPLC), and preparative gel electrophoresis.

Purification of chemically-synthesized peptides can readily be effected, e.g., by HPLC.

Accordingly, it is an aspect of the present invention to provide the isolated proteins of the present invention in pure or substantially pure form.

A purified protein of the present invention is an isolated protein, as above described, that is present at a concentration of at least 95%, as measured on a mass basis (w/w) with respect to total protein in a composition. Such purities can often be obtained during chemical synthesis without further purification, as, e.g., by HPLC. Purified proteins of the present invention can be present at a concentration (measured on a mass basis with respect to total protein in a composition) of 96%, 97%, 98%, and even 99%. The proteins of the present invention can even be present at levels of 99.5%, 99.6%, and even 99.7%, 99.8%, or even 99.9% following purification, as by HPLC.

Although high levels of purity are preferred when the isolated proteins of the present invention are used as therapeutic agents—such as vaccines, or for replacement therapy—the isolated proteins of the present invention are also useful at lower purity. For example, partially purified proteins of the present invention can be used as immunogens to raise antibodies in laboratory animals.

Thus, in another aspect, the present invention provides the isolated proteins of the present invention in substantially purified form. A "substantially purified protein" of the present invention is an isolated protein, as above described, present at a concentration of at least 70%, measured on a mass basis with respect to total protein in a composition. Usefully, the substantially purified protein is present at a concentration, measured on a mass basis with respect to total protein in a composition, of at least 75%, 80%, or even at least 85%, 90%, 91%, 92%, 93%, 94%, 94.5% or even at least 94.9%.

In preferred embodiments, the purified and substantially purified proteins of the present invention are in compositions that lack detectable ampholytes, acrylamide monomers, bis-acrylamide monomers, and polyacrylamide.

The proteins, fragments, and fusions of the present invention can usefully be attached to a substrate. The substrate can porous or solid, planar or non-planar; the bond can be covalent or noncovalent.

For example, the proteins, fragments, and fusions of the present invention can usefully be bound to a porous substrate, commonly a membrane, typically comprising nitrocellulose, polyvinylidene fluoride (PVDF), or cationically derivatized, hydrophilic PVDF; so bound, the proteins, fragments, and fusions of the present invention can be used to detect and quantify antibodies, e.g. in serum, that bind specifically to the immobilized protein of the present invention.

As another example, the proteins, fragments, and fusions of the present invention can usefully be bound to a substantially nonporous substrate, such as plastic, to detect and quantify antibodies, e.g. in serum, that bind specifically to the immobilized protein of the present invention. Such plastics include polymethylacrylic, polyethylene, polypropylene, polyacrylate, polymethylmethacrylate, polyvinylchloride, polytetrafluoroethylene, polystyrene, polycarbonate, polyacetal, polysulfone, celluloseacetate, cellulosenitrate, nitrocellulose, or mixtures thereof; when the assay is performed in standard microtiter dish, the plastic is typically polystyrene.

The proteins, fragments, and fusions of the present invention can also be attached to a substrate suitable for use as a surface enhanced laser desorption ionization source; so attached, the protein, fragment, or fusion of the present invention is useful for binding and then detecting secondary proteins that bind with sufficient affinity or avidity to the surface-bound protein to indicate biologic interaction therebetween. The proteins, fragments, and fusions of the present invention can also be attached to a substrate suitable for use in surface plasmon resonance detection; so attached, the protein, fragment, or fusion of the present invention is useful for binding and then detecting secondary proteins that bind with sufficient affinity or avidity to the surface-bound protein to indicate biological interaction therebetween.

Antibodies and Antibody-producing Cells

In another aspect, the invention provides antibodies, including fragments and derivatives thereof, that bind specifically to hGDMLP-1 proteins and protein fragments of the present invention, or that bind to one or more of the proteins and protein fragments encoded by the isolated hGDMLP-1 nucleic acids of the present invention. The antibodies of the present invention can be specific for linear epitopes, discontinuous epitopes, or conformational epitopes of such proteins or protein fragments, either as present on the protein in its native conformation or, in some cases, as present on the proteins as denatured, as, e.g., by solubilization in SDS.

In other embodiments, the invention provides antibodies, including fragments and derivatives thereof, the binding of which can be competitively inhibited by one or more of the hGDMLP-1 proteins and protein fragments of the present invention, or by one or more of the proteins and protein fragments encoded by the isolated hGDMLP-1 nucleic acids of the present invention.

As used herein, the term "antibody" refers to a polypeptide, at least a portion of which is encoded by at least one immunoglobulin gene, which can bind specifically to a first molecular species, and to fragments or derivatives thereof that remain capable of such specific binding.

By "bind specifically" and "specific binding" is here intended the ability of the antibody to bind to a first molecular species in preference to binding to other molecular species with which the antibody and first molecular species are admixed. An antibody is said specifically to "recognize" a first molecular species when it can bind specifically to that first molecular species.

As is well known in the art, the degree to which an antibody can discriminate as among molecular species in a mixture will depend, in part, upon the conformational relatedness of the species in the mixture; typically, the antibodies of the present invention will discriminate over adventitious binding to non-hGDMLP-1 proteins by at least two-fold, more typically by at least 5-fold, typically by more than 10-fold, 25-fold, 50-fold, 75-fold, and often by more than 100-fold, and on occasion by more than 500-fold or 1000-fold. When used to detect the proteins or protein fragments of the present invention, the antibody of the present invention is sufficiently specific when it can be used to determine the presence of the protein of the present invention in samples derived from human heart or skeletal muscle.

Typically, the affinity or avidity of an antibody (or antibody multimer, as in the case of an IgM pentamer) of the present invention for a protein or protein fragment of the present invention will be at least about $1\times10^{-6}$ molar (M), typically at least about $5\times10^{-7}$ M, usefully at least about $1\times10^{-7}$ M, with affinities and avidities of at least $1\times10^{-8}$ M, $5\times10^{-9}$ M, and $1\times10^{-10}$ M proving especially useful.

The antibodies of the present invention can be naturally-occurring forms, such as IgG, IgM, IgD, IgE, and IgA, from any mammalian species.

Human antibodies can, but will infrequently, be drawn directly from human donors or human cells. In such case, antibodies to the proteins of the present invention will typically have resulted from fortuitous immunization, such as autoimmune immunization, with the protein or protein fragments of the present invention. Such antibodies will typically, but will not invariably, be polyclonal.

Human antibodies are more frequently obtained using transgenic animals that express human immunoglobulin genes, which transgenic animals can be affirmatively immunized with the protein immunogen of the present invention. Human Ig-transgenic mice capable of producing human antibodies and methods of producing human antibodies therefrom upon specific immunization are described, inter alia, in U.S. Pat. Nos. 6,162,963; 6,150,584; 6,114,598; 6,075,181; 5,939,598; 5,877,397; 5,874,299; 5,814,318; 5,789,650; 5,770,429; 5,661,016; 5,633,425; 5,625,126; 5,569,825; 5,545,807; 5,545,806, and 5,591,669, the disclosures of which are incorporated herein by reference in their entireties. Such antibodies are typically monoclonal, and are typically produced using techniques developed for production of murine antibodies.

Human antibodies are particularly useful, and often preferred, when the antibodies of the present invention are to be administered to human beings as in vivo diagnostic or therapeutic agents, since recipient immune response to the administered antibody will often be substantially less than that occasioned by administration of an antibody derived from another species, such as mouse.

IgG, IgM, IgD, IgE and IgA antibodies of the present invention are also usefully obtained from other mammalian species, including rodents typically mouse, but also rat, guinea pig, and hamster—lagomorphs, typically rabbits, and also larger mammals, such as sheep, goats, cows, and horses. In such cases, as with the transgenic human-antibody-producing non-human mammals, fortuitous immunization is not required, and the non-human mammal is typically affirmatively immunized, according to standard immunization protocols, with the protein or protein fragment of the present invention.

As discussed above, virtually all fragments of 8 or more contiguous amino acids of the proteins of the present invention can be used effectively as immunogens when conjugated to a carrier, typically a protein such as bovine thyroglobulin, keyhole limpet hemocyanin, or bovine serum albumin, conveniently using a bifunctional linker such as those described elsewhere above, which discussion is incorporated by reference here.

Immunogenicity can also be conferred by fusion of the proteins and protein fragments of the present invention to other moieties.

For example, peptides of the present invention can be produced by solid phase synthesis on a branched polylysine core matrix; these multiple antigenic peptides (MAPs) provide high purity, increased avidity, accurate chemical definition and improved safety in vaccine development. Tam et al., Proc. Natl. Acad. Sci. USA 85:5409–5413 (1988); Posnett et al., *J. Biol. Chem.* 263, 1719–1725 (1988).

Protocols for immunizing non-human mammals are well-established in the art, Harlow et al. (eds.), *Antibodies: A Laboratory Manual*, Cold Spring Harbor Laboratory (1998) (ISBN: 0879693142); Coligan et al. (eds.), *Current Protocols in Immunology*, John Wiley & Sons, Inc. (2001) (ISBN: 0-471-52276-7); Zola, *Monoclonal Antibodies: Preparation and Use of Monoclonal Antibodies and Engineered Antibody Derivatives (Basics: From Background to Bench)*, Springer Verlag (2000) (ISBN: 0387915907), the disclosures of which are incorporated herein by reference, and often include multiple immunizations, either with or without adjuvants such as Freund's complete adjuvant and Freund's incomplete adjuvant.

Antibodies from nonhuman mammals can be polyclonal or monoclonal, with polyclonal antibodies having certain advantages in immunohistochemical detection of the proteins of the present invention and monoclonal antibodies having advantages in identifying and distinguishing particular epitopes of the proteins of the present invention.

Following immunization, the antibodies of the present invention can be produced using any art-accepted technique.

Such techniques are well known in the art, Coligan et al. (eds.), *Current Protocols in Immunology*, John Wiley & Sons, Inc. (2001) (ISBN: 0-471-52276-7); Zola, *Monoclonal Antibodies: Preparation and Use of Monoclonal Antibodies and Engineered Antibody Derivatives* (*Basics: From Background to Bench*), Springer Verlag (2000) (ISBN: 0387915907); Howard et al. (eds.), *Basic Methods in Antibody Production and Characterization*, CRC Press (2000) (ISBN: 0849394457); Harlow et al. (eds.), *Antibodies: A Laboratory Manual*, Cold Spring Harbor Laboratory (1998) (ISBN: 0879693142); Davis (ed.), *Monoclonal Antibody Protocols*, Vol. 45, Humana Press (1995) (ISBN: 0896033082); Delves (ed.), *Antibody Production: Essential Techniques*, John Wiley & Son Ltd (1997) (ISBN: 0471970107); Kenney, *Antibody Solution: An Antibody Methods Manual*, Chapman & Hall (1997) (ISBN: 0412141914), incorporated herein by reference in their entireties, and thus need not be detailed here.

Briefly, however, such techniques include, inter alia, production of monoclonal antibodies by hybridomas and expression of antibodies or fragments or derivatives thereof from host cells engineered to express immunoglobulin genes or fragments thereof. These two methods of production are not mutually exclusive: genes encoding antibodies specific for the proteins or protein fragments of the present invention can be cloned from hybridomas and thereafter expressed in other host cells. Nor need the two necessarily be performed together: e.g., genes encoding antibodies specific for the proteins and protein fragments of the present invention can be cloned directly from B cells known to be specific for the desired protein, as further described in U.S. Pat. No. 5,627,052, the disclosure of which is incorporated herein by reference in its entirety, or from antibody-displaying phage.

Recombinant expression in host cells is particularly useful when fragments or derivatives of the antibodies of the present invention are desired.

Host cells for recombinant antibody production—either whole antibodies, antibody fragments, or antibody derivatives—can be prokaryotic or eukaryotic.

Prokaryotic hosts are particularly useful for producing phage displayed antibodies of the present invention.

The technology of phage-displayed antibodies, in which antibody variable region fragments are fused, for example, to the gene III protein (pIII) or gene VIII protein (PVIII) for display on the surface of filamentous phage, such as M13, is by now well-established, Sidhu, *Curr. Opin. Biotechnol.* 11(6):610–6 (2000); Griffiths et al., *Curr. Opin. Biotechnol.* 9(1):102–8 (1998); Hoogenboom et al., *Immunotechnology*, 4(1):1–20 (1998); Rader et al., *Current Opinion in Biotechnology* 8:503–508 (1997); Aujame et al., *Human Antibodies* 8:155–168 (1997); Hoogenboom, *Trends in Biotechnol.* 15:62–70 (1997); de Kruif et al., 17:453–455 (1996); Barbas et al., *Trends in Biotechnol.* 14:230–234 (1996); Winter et al., *Ann. Rev. Immunol.* 433–455 (1994), and techniques and protocols required to generate, propagate, screen (pan), and use the antibody fragments from such libraries have recently been compiled, Barbas et al., *Phage Display: A Laboratory Manual*, Cold Spring Harbor Laboratory Press (2001) (ISBN 0-87969-546-3); Kay et al. (eds.), *Phage Display of Peptides and Proteins: A Laboratory Manual*, Academic Press, Inc. (1996); Abelson et al. (eds.), *Combinatorial Chemistry*, Methods in Enzymology vol. 267, Academic Press (May 1996), the disclosures of which are incorporated herein by reference in their entireties.

Typically, phage-displayed antibody fragments are scFv fragments or Fab fragments; when desired, full length antibodies can be produced by cloning the variable regions from the displaying phage into a complete antibody and expressing the full length antibody in a further prokaryotic or a eukaryotic host cell.

Eukaryotic cells are also useful for expression of the antibodies, antibody fragments, and antibody derivatives of the present invention.

For example, antibody fragments of the present invention can be produced in Pichia pastoris, Takahashi et al., *Biosci. Biotechnol. Biochem.* 64(10):2138–44 (2000); Freyre et al., *J. Biotechnol.* 76(2–3):157–63 (2000); Fischer et al., *Biotechnol. Appl. Biochem.* 30 (Pt 2):117–20 (1999); Pennell et al., *Res. Immunol.* 149(6):599–603 (1998); Eldin et al., *J. Immunol. Methods.* 201(1):67–75 (1997); and in *Saccharomyces cerevisiae*, Frenken et al., *Res. Immunol.* 149(6): 589–99 (1998); Shusta et al., *Nature Biotechnol.* 16(8): 773–7 (1998), the disclosures of which are incorporated herein by reference in their entireties.

Antibodies, including antibody fragments and derivatives, of the present invention can also be produced in insect cells, Li et al., *Protein Expr. Purif.* 21(1):121–8 (2001); Ailor et al., *Biotechnol. Bioeng.* 58(2–3):196–203 (1998); Hsu et al., *Biotechnol. Prog.* 13(1):96–104 (1997); Edelman et al., *Immunology* 91(1):13–9 (1997); and Nesbit et al., *J. Immunol. Methods.* 151(1–2):201–8 (1992), the disclosures of which are incorporated herein by reference in their entireties.

Antibodies and fragments and derivatives thereof of the present invention can also be produced in plant cells, Giddings et al., *Nature Biotechnol.* 18(11):1151–5 (2000); Gavilondo et al., *Biotechniques* 29(1):128–38 (2000); Fischer et al., *J. Biol. Regul. Homeost. Agents* 14(2):83–92 (2000); Fischer et al., *Biotechnol. Appl. Biochem.* 30 (Pt 2):113–6 (1999); Fischer et al., *Biol. Chem.* 380(7–8): 825–39 (1999); Russell, *Curr. Top. Microbiol. Immunol.* 240:119–38 (1999); and Ma et al., *Plant Physiol.* 109(2): 341–6 (1995), the disclosures of which are incorporated herein by reference in their entireties.

Mammalian cells useful for recombinant expression of antibodies, antibody fragments, and antibody derivatives of the present invention include CHO cells, COS cells, 293 cells, and myeloma cells.

Verma et al., *J. Immunol. Methods* 216(1–2):165–81 (1998), review and compare bacterial, yeast, insect and mammalian expression systems for expression of antibodies.

Antibodies of the present invention can also be prepared by cell free translation, as further described in Merk et al., *J. Biochem. (Tokyo).* 125(2):328–33 (1999) and Ryabova et al., *Nature Biotechnol.* 15(1):79–84 (1997), and in the milk of transgenic animals, as further described in Pollock et al., *J. Immunol. Methods* 231(1–2):147–57 (1999), the disclosures of which are incorporated herein by reference in their entireties.

The invention further provides antibody fragments that bind specifically to one or more of the proteins and protein fragments of the present invention, to one or more of the proteins and protein fragments encoded by the isolated nucleic acids of the present invention, or the binding of which can be competitively inhibited by one or more of the proteins and protein fragments of the present invention or one or more of the proteins and protein fragments encoded by the isolated nucleic acids of the present invention.

Among such useful fragments are Fab, Fab', Fv, F(ab)'$_2$, and single chain Fv (scFv) fragments. Other useful fragments are described in Hudson, *Curr. Opin. Biotechnol.* 9(4):395–402 (1998).

It is also an aspect of the present invention to provide antibody derivatives that bind specifically to one or more of the proteins and protein fragments of the present invention, to one or more of the proteins and protein fragments encoded by the isolated nucleic acids of the present invention, or the binding of which can be competitively inhibited by one or more of the proteins and protein fragments of the present invention or one or more of the proteins and protein fragments encoded by the isolated nucleic acids of the present invention.

Among such useful derivatives are chimeric, primatized, and humanized antibodies; such derivatives are less immunogenic in human beings, and thus more suitable for in vivo administration, than are unmodified antibodies from non-human mammalian species.

Chimeric antibodies typically include heavy and/or light chain variable regions (including both CDR and framework residues) of immunoglobulins of one species, typically mouse, fused to constant regions of another species, typically human. See, e.g., U.S. Pat. No. 5,807,715; Morrison et al., *Proc. Natl. Acad. Sci USA.* 81(21):6851–5 (1984); Sharon et al., *Nature* 309(5966):364–7 (1984); Takeda et al., *Nature* 314(6010):452–4 (1985), the disclosures of which are incorporated herein by reference in their entireties. Primatized and humanized antibodies typically include heavy and/or light chain CDRs from a murine antibody grafted into a non-human primate or human antibody V region framework, usually further comprising a human constant region, Riechmann et al., *Nature* 332(6162):323–7 (1988); Co et al., *Nature* 351(6326):501–2 (1991); U.S. Pat. Nos. 6,054,297; 5,821,337; 5,770,196; 5,766,886; 5,821,123; 5,869,619; 6,180,377; 6,013,256; 5,693,761; and 6,180,370, the disclosures of which are incorporated herein by reference in their entireties.

Other useful antibody derivatives of the invention include heteromeric antibody complexes and antibody fusions, such as diabodies (bispecific antibodies), single-chain diabodies, and intrabodies.

The antibodies of the present invention, including fragments and derivatives thereof, can usefully be labeled. It is, therefore, another aspect of the present invention to provide labeled antibodies that bind specifically to one or more of the proteins and protein fragments of the present invention, to one or more of the proteins and protein fragments encoded by the isolated nucleic acids of the present invention, or the binding of which can be competitively inhibited by one or more of the proteins and protein fragments of the present invention or one or more of the proteins and protein fragments encoded by the isolated nucleic acids of the present invention.

The choice of label depends, in part, upon the desired use.

For example, when the antibodies of the present invention are used for immunohistochemical staining of tissue samples, the label can usefully be an enzyme that catalyzes production and local deposition of a detectable product.

Enzymes typically conjugated to antibodies to permit their immunohistochemical visualization are well known, and include alkaline phosphatase, β-galactosidase, glucose oxidase, horseradish peroxidase (HRP), and urease. Typical substrates for production and deposition of visually detectable products include o-nitrophenyl-beta-D-galactopyranoside (ONPG); o-phenylenediamine dihydrochloride (OPD); p-nitrophenyl phosphate (PNPP); p-nitrophenyl-beta-D-galactopryanoside (PNPG); 3',3'-diaminobenzidine (DAB); 3-amino-9-ethylcarbazole (AEC); 4-chloro-1-naphthol (CN); 5-bromo-4-chloro-3-indolyl-phosphate (BCIP); ABTS®; BluoGal; iodonitrotetrazolium (INT); nitroblue tetrazolium chloride (NBT); phenazine methosulfate (PMS); phenolphthalein monophosphate (PMP); tetramethyl benzidine (TMB); tetranitroblue tetrazolium (TNBT); X-Gal; X-Gluc; and X-Glucoside.

Other substrates can be used to produce products for local deposition that are luminescent. For example, in the presence of hydrogen peroxide ($H_2O_2$), horseradish peroxidase (HRP) can catalyze the oxidation of cyclic diacylhydrazides, such as luminol. Immediately following the oxidation, the luminol is in an excited state (intermediate reaction product), which decays to the ground state by emitting light. Strong enhancement of the light emission is produced by enhancers, such as phenolic compounds. Advantages include high sensitivity, high resolution, and rapid detection without radioactivity and requiring only small amounts of antibody. See, e.g., Thorpe et al., *Methods Enzymol.* 133:331–53 (1986); Kricka et al., *J. Immunoassay* 17(1): 67–83 (1996); and Lundqvist et al., *J. Biolumin. Chemilumin.* 10(6):353–9 (1995), the disclosures of which are incorporated herein by reference in their entireties. Kits for such enhanced chemiluminescent detection (ECL) are available commercially.

The antibodies can also be labeled using colloidal gold.

As another example, when the antibodies of the present invention are used, e.g., for flow cytometric detection, for scanning laser cytometric detection, or for fluorescent immunoassay, they can usefully be labeled with fluorophores.

There are a wide variety of fluorophore labels that can usefully be attached to the antibodies of the present invention.

For flow cytometric applications, both for extracellular detection and for intracellular detection, common useful fluorophores can be fluorescein isothiocyanate (FITC), allophycocyanin (APC), R-phycoerythrin (PE), peridinin chlorophyll protein (PerCP), Texas Red, Cy3, Cy5, fluorescence resonance energy tandem fluorophores such as PerCP-Cy5.5, PE-Cy5, PE-Cy5.5, PE-Cy7, PE-Texas Red, and APC-Cy7.

Other fluorophores include, inter alia, Alexa Fluor® 350, Alexa Fluor® 488, Alexa Fluor® 532, Alexa Fluor® 546, Alexa Fluor® 568, Alexa Fluor® 594, Alexa Fluor® 647 (monoclonal antibody labeling kits available from Molecular Probes, Inc., Eugene, Oreg., USA), BODIPY dyes, such as BODIPY 493/503, BODIPY FL, BODIPY R6G, BODIPY 530/550, BODIPY TMR, BODIPY 558/568, BODIPY 558/568, BODIPY 564/570, BODIPY 576/589, BODIPY 581/591, BODIPY TR, BODIPY 630/650, BODIPY 650/665, Cascade Blue, Cascade Yellow, Dansyl, lissamine rhodamine B, Marina Blue, Oregon Green 488, Oregon Green 514, Pacific Blue, rhodamine 6G, rhodamine green, rhodamine red, tetramethylrhodamine, Texas Red (available from Molecular Probes, Inc., Eugene, Oreg., USA), and Cy2, Cy3, Cy3.5, Cy5, Cy5.5, Cy7, all of which are also useful for fluorescently labeling the antibodies of the present invention.

For secondary detection using labeled avidin, streptavidin, captavidin or neutravidin, the antibodies of the present invention can usefully be labeled with biotin.

When the antibodies of the present invention are used, e.g., for western blotting applications, they can usefully be labeled with radioisotopes, such as $^{33}P$, $^{32}P$, $^{35}S$, $^{3}H$, and $^{125}I$.

As another example, when the antibodies of the present invention are used for radioimmunotherapy, the label can usefully be $^{228}Th$, $^{227}Ac$, $^{225}Ac$, $^{223}Ra$, $^{213}Bi$, $^{212}Pb$, $^{212}Bi$, $^{211}At$, $^{203}Pb$, $^{194}Os$, $^{188}Re$, $^{186}Re$, $^{153}Sm$, $^{149}Tb$, $^{131}I$, $^{125}I$, $^{111}In$, $^{105}Rh$, $^{99m}Tc$, $^{97}Ru$, $^{90}Y$, $^{90}Sr$, $^{88}Y$, $^{72}Se$, $^{67}Cu$, or $^{47}Sc$.

As another example, when the antibodies of the present invention are to be used for in vivo diagnostic use, they can be rendered detectable by conjugation to MRI contrast agents, such as gadolinium diethylenetriaminepentaacetic acid (DTPA), Lauffer et al., *Radiology* 207(2):529–38 (1998), or by radioisotopic labeling.

As would be understood, use of the labels described above is not restricted to the application as for which they were mentioned.

The antibodies of the present invention, including fragments and derivatives thereof, can also be conjugated to toxins, in order to target the toxin's ablative action to cells that display and/or express the proteins of the present invention. Commonly, the antibody in such immunotoxins is conjugated to Pseudomonas exotoxin A, diphtheria toxin, shiga toxin A, anthrax toxin lethal factor, or ricin. See Hall (ed.), *Immunotoxin Methods and Protocols* (Methods in Molecular Biology, Vol 166), Humana Press (2000) (ISBN:0896037754); and Frankel et al. (eds.), *Clinical Applications of Immunotoxins*, Springer-Verlag New York, Incorporated (1998) (ISBN:3540640975), the disclosures of which are incorporated herein by reference in their entireties, for review.

The antibodies of the present invention can usefully be attached to a substrate, and it is, therefore, another aspect of the invention to provide antibodies that bind specifically to one or more of the proteins and protein fragments of the present invention, to one or more of the proteins and protein fragments encoded by the isolated nucleic acids of the present invention, or the binding of which can be competitively inhibited by one or more of the proteins and protein fragments of the present invention or one or more of the proteins and protein fragments encoded by the isolated nucleic acids of the present invention, attached to a substrate.

Substrates can be porous or nonporous, planar or nonplanar.

For example, the antibodies of the present invention can usefully be conjugated to filtration media, such as NHS-activated Sepharose or CNBr-activated Sepharose for purposes of immunoaffinity chromatography.

For example, the antibodies of the present invention can usefully be attached to paramagnetic microspheres, typically by biotin-streptavidin interaction, which microsphere can then be used for isolation of cells that express or display the proteins of the present invention. As another example, the antibodies of the present invention can usefully be attached to the surface of a microtiter plate for ELISA.

As noted above, the antibodies of the present invention can be produced in prokaryotic and eukaryotic cells. It is, therefore, another aspect of the present invention to provide cells that express the antibodies of the present invention, including hybridoma cells, B cells, plasma cells, and host cells recombinantly modified to express the antibodies of the present invention.

In yet a further aspect, the present invention provides aptamers evolved to bind specifically to one or more of the proteins and protein fragments of the present invention, to one or more of the proteins and protein fragments encoded by the isolated nucleic acids of the present invention, or the binding of which can be competitively inhibited by one or more of the proteins and protein fragments of the present invention or one or more of the proteins and protein fragments encoded by the isolated nucleic acids of the present invention.

Pharmaceutical Compositions hGDMLP-1 is important to the proper functioning of skeletal and cardiac muscle cells; defects in hGDMLP-1 expression, activity, expression, activity, distribution, localization, and/or solubility are a cause of human disease, which disease can manifest as a disorder of heart and/or skeletal muscle function.

Accordingly, pharmaceutical compositions comprising nucleic acids, proteins, and antibodies of the present invention, as well as mimetics, agonists, antagonists, or inhibitors of hGDMLP-1 activity, can be administered as therapeutics for treatment of hGDMLP-1 defects.

Thus, in another aspect, the invention provides pharmaceutical compositions comprising the nucleic acids, nucleic acid fragments, proteins, protein fusions, protein fragments, antibodies, antibody derivatives, antibody fragments, mimetics, agonists, antagonists, and inhibitors of the present invention.

Such a composition typically contains from about 0.1 to 90% by weight of a therapeutic agent of the invention formulated in and/or with a pharmaceutically acceptable carrier or excipient.

Pharmaceutical formulation is a well-established art, and is further described in Gennaro (ed.), *Remington: The Science and Practice of Pharmacy*, $20^{th}$ ed., Lippincott, Williams & Wilkins (2000) (ISBN: 0683306472); Ansel et al., *Pharmaceutical Dosage Forms and Drug Delivery Systems*, $7^{th}$ ed., Lippincott Williams & Wilkins Publishers (1999) (ISBN: 0683305727); and Kibbe (ed.), *Handbook of Pharmaceutical Excipients* American Pharmaceutical Association, $3^{rd}$ ed. (2000) (ISBN: 091733096X), the disclosures of which are incorporated herein by reference in their entireties, and thus need not be described in detail herein.

Briefly, however, formulation of the pharmaceutical compositions of the present invention will depend upon the route chosen for administration. The pharmaceutical compositions utilized in this invention can be administered by various routes including both enteral and parenteral routes, including oral, intravenous, intramuscular, subcutaneous, inhalation, topical, sublingual, rectal, intra-arterial, intramedullary, intrathecal, intraventricular, transmucosal, transdermal, intranasal, intraperitoneal, intrapulmonary, and intrauterine.

Oral dosage forms can be formulated as tablets, pills, dragees, capsules, liquids, gels, syrups, slurries, suspensions, and the like, for ingestion by the patient.

Solid formulations of the compositions for oral administration can contain suitable carriers or excipients, such as carbohydrate or protein fillers, such as sugars, including lactose, sucrose, mannitol, or sorbitol; starch from corn, wheat, rice, potato, or other plants; cellulose, such as methyl cellulose, hydroxypropylmethyl-cellulose, sodium carboxymethylcellulose, or microcrystalline cellulose; gums including arabic and tragacanth; proteins such as gelatin and collagen; inorganics, such as kaolin, calcium carbonate, dicalcium phosphate, sodium chloride; and other agents such as acacia and alginic acid.

Agents that facilitate disintegration and/or solubilization can be added, such as the cross-linked polyvinyl pyrrolidone, agar, alginic acid, or a salt thereof, such as sodium alginate, microcrystalline cellulose, corn starch, sodium starch glycolate, and alginic acid.

Tablet binders that can be used include acacia, methylcellulose, sodium carboxymethylcellulose, polyvinylpyrrolidone (Povidone™), hydroxypropyl methylcellulose, sucrose, starch and ethylcellulose.

Lubricants that can be used include magnesium stearates, stearic acid, silicone fluid, talc, waxes, oils, and colloidal silica.

Fillers, agents that facilitate disintegration and/or solubilization, tablet binders and lubricants, including the aforementioned, can be used singly or in combination.

Solid oral dosage forms need not be uniform throughout.

For example, dragee cores can be used in conjunction with suitable coatings, such as concentrated sugar solutions, which can also contain gum arabic, talc, polyvinylpyrrolidone, carbopol gel, polyethylene glycol, and/or titanium dioxide, lacquer solutions, and suitable organic solvents or solvent mixtures.

Oral dosage forms of the present invention include push-fit capsules made of gelatin, as well as soft, sealed capsules made of gelatin and a coating, such as glycerol or sorbitol. Push-fit capsules can contain active ingredients mixed with a filler or binders, such as lactose or starches, lubricants, such as talc or magnesium stearate, and, optionally, stabilizers. In soft capsules, the active compounds can be dissolved or suspended in suitable liquids, such as fatty oils, liquid, or liquid polyethylene glycol with or without stabilizers.

Additionally, dyestuffs or pigments can be added to the tablets or dragee coatings for product identification or to characterize the quantity of active compound, i.e., dosage.

Liquid formulations of the pharmaceutical compositions for oral (enteral) administration are prepared in water or other aqueous vehicles and can contain various suspending agents such as methylcellulose, alginates, tragacanth, pectin, kelgin, carrageenan, acacia, polyvinylpyrrolidone, and polyvinyl alcohol. The liquid formulations can also include solutions, emulsions, syrups and elixirs containing, together with the active compound(s), wetting agents, sweeteners, and coloring and flavoring agents.

The pharmaceutical compositions of the present invention can also be formulated for parenteral administration.

For intravenous injection, water soluble versions of the compounds of the present invention are formulated in, or if provided as a lyophilate, mixed with, a physiologically acceptable fluid vehicle, such as 5% dextrose ("D5"), physiologically buffered saline, 0.9% saline, Hanks' solution, or Ringer's solution.

Intramuscular preparations, e.g. a sterile formulation of a suitable soluble salt form of the compounds of the present invention, can be dissolved and administered in a pharmaceutical excipient such as Water-for-Injection, 0.9% saline, or 5% glucose solution. Alternatively, a suitable insoluble form of the compound can be prepared and administered as a suspension in an aqueous base or a pharmaceutically acceptable oil base, such as an ester of a long chain fatty acid (e.g., ethyl oleate), fatty oils such as sesame oil, triglycerides, or liposomes.

Parenteral formulations of the compositions can contain various carriers such as vegetable oils, dimethylacetamide, dimethylformamide, ethyl lactate, ethyl carbonate, isopropyl myristate, ethanol, polyols (glycerol, propylene glycol, liquid polyethylene glycol, and the like).

Aqueous injection suspensions can also contain substances that increase the viscosity of the suspension, such as sodium carboxymethyl cellulose, sorbitol, or dextran. Non-lipid polycationic amino polymers can also be used for delivery. Optionally, the suspension can also contain suitable stabilizers or agents that increase the solubility of the compounds to allow for the preparation of highly concentrated solutions.

Pharmaceutical compositions of the present invention can also be formulated to permit injectable, long-term, deposition.

The pharmaceutical compositions of the present invention can be administered topically.

A topical semi-solid ointment formulation typically contains a concentration of the active ingredient from about 1 to 20%, e.g., 5 to 10%, in a carrier such as a pharmaceutical cream base. Various formulations for topical use include drops, tinctures, lotions, creams, solutions, and ointments containing the active ingredient and various supports and vehicles. In other transdermal formulations, typically in patch-delivered formulations, the pharmaceutically active compound is formulated with one or more skin penetrants, such as 2-N-methyl-pyrrolidone (NMP) or Azone.

Inhalation formulations can also readily be formulated. For inhalation, various powder and liquid formulations can be prepared.

The pharmaceutically active compound in the pharmaceutical compositions of the present inention can be provided as the salt of a variety of acids, including but not limited to hydrochloric, sulfuric, acetic, lactic, tartaric, malic, and succinic acid. Salts tend to be more soluble in aqueous or other protonic solvents than are the corresponding free base forms.

After pharmaceutical compositions have been prepared, they are packaged in an appropriate container and labeled for treatment of an indicated condition.

The active compound will be present in an amount effective to achieve the intended purpose. The determination of an effective dose is well within the capability of those skilled in the art.

A "therapeutically effective dose" refers to that amount of active ingredient—for example hGDMLP-1 protein, fusion protein, or fragments thereof, antibodies specific for hGDMLP-1, agonists, antagonists or inhibitors of hGDMLP-1—which ameliorates the signs or symptoms of the disease or prevents progression thereof; as would be understood in the medical arts, cure, although desired, is not required.

The therapeutically effective dose of the pharmaceutical agents of the present invention can be estimated initially by in vitro tests, such as cell culture assays, followed by assay in model animals, usually mice, rats, rabbits, dogs, or pigs. The animal model can also be used to determine an initial preferred concentration range and route of administration.

For example, the ED50 (the dose therapeutically effective in 50% of the population) and LD50 (the dose lethal to 50% of the population) can be determined in one or more cell culture of animal model systems. The dose ratio of toxic to therapeutic effects is the therapeutic index, which can be expressed as LD50/ED50. Pharmaceutical compositions that exhibit large therapeutic indices are preferred.

The data obtained from cell culture assays and animal studies is used in formulating an initial dosage range for human use, and preferably provides a range of circulating concentrations that includes the ED50 with little or no toxicity. After administration, or between successive administrations, the circulating concentration of active agent varies within this range depending upon pharmacokinetic factors well known in the art, such as the dosage form employed, sensitivity of the patient, and the route of administration.

The exact dosage will be determined by the practitioner, in light of factors specific to the subject requiring treatment. Factors that can be taken into account by the practitioner include the severity of the disease state, general health of the subject, age, weight, gender of the subject, diet, time and frequency of administration, drug combination(s), reaction sensitivities, and tolerance/response to therapy. Long-acting pharmaceutical compositions can be administered every 3 to 4 days, every week, or once every two weeks depending on half-life and clearance rate of the particular formulation.

Normal dosage amounts may vary from 0.1 to 100,000 micrograms, up to a total dose of about 1 g, depending upon the route of administration. Where the therapeutic agent is a protein or antibody of the present invention, the therapeutic protein or antibody agent typically is administered at a daily dosage of 0.01 mg to 30 mg/kg of body weight of the patient (e.g., 1 mg/kg to 5 mg/kg). The pharmaceutical formulation can be administered in multiple doses per day, if desired, to achieve the total desired daily dose.

Guidance as to particular dosages and methods of delivery is provided in the literature and generally available to practitioners in the art. Those skilled in the art will employ different formulations for nucleotides than for proteins or their inhibitors. Similarly, delivery of polynucleotides or polypeptides will be specific to particular cells, conditions, locations, etc.

Conventional methods, known to those of ordinary skill in the art of medicine, can be used to administer the pharmaceutical formulation(s) of the present invention to the patient. The pharmaceutical compositions of the present invention can be administered alone, or in combination with other therapeutic agents or interventions.

Therapeutic Methods

The present invention further provides methods of treating subjects having defects in hGDMLP-1—e.g., in expression, activity, distribution, localization, and/or solubility of hGDMLP-1—which can manifest as a disorder of heart and/or skeletal muscle function. As used herein, "treating" includes all medically-acceptable types of therapeutic intervention, including palliation and prophylaxis (prevention) of disease.

In one embodiment of the therapeutic methods of the present invention, a therapeutically effective amount of a pharmaceutical composition comprising hGDMLP-1 protein, fusion, fragment or derivative thereof is administered to a subject with a clinically-significant hGDMLP-1 defect.

Protein compositions are administered, for example, to complement a deficiency in native hGDMLP-1. In other embodiments, protein compositions are administered as a vaccine to elicit a humoral and/or cellular immune response to hGDMLP-1. The immune response can be used to modulate activity of hGDMLP-1 or, depending on the immunogen, to immunize against aberrant or aberrantly expressed forms, such as mutant or inappropriately expressed isoforms. In yet other embodiments, protein fusions having a toxi moiety are administered to ablate cells that aberrantly accumulate hGDMLP-1.

In another embodiment of the therapeutic methods of the present invention, a therapeutically effective amount of a pharmaceutical composition comprising nucleic acid of the present invention is administered. The nucleic acid can be delivered in a vector that drives expression of hGDMLP-1 protein, fusion, or fragment thereof, or without such vector.

Nucleic acid compositions that can drive expression of hGDMLP-1 are administered, for example, to complement a deficiency in native hGDMLP-1, or as DNA vaccines. Expression vectors derived from virus, replication deficient retroviruses, adenovirus, adeno-associated (AAV) virus, herpes virus, or vaccinia virus can be used—see, e.g., Cid-Arregui (ed.), *Viral Vectors: Basic Science and Gene Therapy*, Eaton Publishing Co., 2000 (ISBN: 188129935X)— as can plasmids.

Antisense nucleic acid compositions, or vectors that drive expression of hGDMLP-1 antisense nucleic acids, are administered to downregulate transcription and/or translation of hGDMLP-1 in circumstances in which excessive production, or production of aberrant protein, is the pathophysiologic basis of disease.

Antisense compositions useful in therapy can have sequence that is complementary to coding or to noncoding regions of the hGDMLP-1 gene. For example, oligonucleotides derived from the transcription initiation site, e.g., between positions −10 and +10 from the start site, are preferred.

Catalytic antisense compositions, such as ribozymes, that are capable of sequence-specific hybridization to hGDMLP-1 transcripts, are also useful in therapy. See, e.g., Phylactou, *Adv. Drug Deliv. Rev.* 44(2–3):97–108 (2000); Phylactou et al., *Hum. Mol. Genet.* 7(10):1649–53 (1998); Rossi, *Ciba Found. Symp.* 209:195–204 (1997); and Sigurdsson et al., *Trends Biotechnol.* 13(8):286–9 (1995), the disclosures of which are incorporated herein by reference in their entireties.

Other nucleic acids useful in the therapeutic methods of the present invention are those that are capable of triplex helix formation in or near the hGDMLP-1 genomic locus. Such triplexing oligonucleotides are able to inhibit transcription, Intody et al., *Nucleic Acids Res.* 28(21): 4283–90 (2000); McGuffie et al., *Cancer Res.* 60(14): 3790–9 (2000), the disclosures of which are incorporated herein by reference, and pharmaceutical compositions comprising such triplex forming oligos (TFOS) are administered in circumstances in which excessive production, or production of aberrant protein, is a pathophysiologic basis of disease.

In another embodiment of the therapeutic methods of the present invention, a therapeutically effective amount of a pharmaceutical composition comprising an antibody (including fragment or derivative thereof) of the present invention is administered. As is well known, antibody compositions are administered, for example, to antagonize activity of hGDMLP-1, or to target therapeutic agents to sites of hGDMLP-1 presence and/or accumulation.

In another embodiment of the therapeutic methods of the present invention, a pharmaceutical composition comprising a non-antibody antagonist of hGDMLP-1 is administered. Antagonists of hGDMLP-1 can be produced using methods generally known in the art. In particular, purified hGDMLP-1 can be used to screen libraries of pharmaceutical agents, often combinatorial libraries of small molecules, to identify those that specifically bind and antagonize at least one activity of hGDMLP-1.

In other embodiments a pharmaceutical composition comprising an agonist of hGDMLP-1 is administered. Agonists can be identified using methods analogous to those used to identify antagonists.

In still other therapeutic methods of the present invention, pharmaceutical compositions comprising host cells that express hGDMLP-1, fusions, or fragments thereof can be administered. In such cases, the cells are typically autologous, so as to circumvent xenogeneic or allotypic rejection, and are administered to complement defects in hGDMLP-1 production or activity.

In other embodiments, pharmaceutical compositions comprising the hGDMLP-1 proteins, nucleic acids, antibodies, antagonists, and agonists of the present invention can be administered in combination with other appropriate therapeutic agents. Selection of the appropriate agents for use in combination therapy can be made by one of ordinary skill in the art according to conventional pharmaceutical principles. The combination of therapeutic agents or approaches can act additively or synergistically to effect the treatment or prevention of the various disorders described above, providing greater therapeutic efficacy and/or permitting use of the pharmaceutical compositions of the present invention using lower dosages, reducing the potential for adverse side effects.

Transgenic Animals and Cells

In another aspect, the invention provides transgenic cells and non-human organisms comprising hGDMLP-1 nucleic acids, and transgenic cells and non-human organisms with targeted disruption of the endogenous orthologue of the human hGDMLP-1 gene.

The cells can be embryonic stem cells or somatic cells. The transgenic non-human organisms can be chimeric, nonchimeric heterozygotes, and nonchimeric homozygotes.

Diagnostic Methods

In order to diagnose, monitor, or assess predisposition to diseases caused by changes in the hGDMLP-1 gene, the nucleic acids of the present invention can be used as hybridization probes to assess the sequence and, at a grosser level, genomic structure of the hGDMLP-1 gene in samples of genomic DNA. The nucleic acids can also be used as hybridization probes to assess the levels of hGDMLP-1 mRNA in a sample derived from heart or muscle. Antibodies of the present invention can be used to assess the expression levels of hGMDLP-1 proteins in heart or muscle.

In another aspect, antibodies which specifically bind hGDMLP-1 may be used for the diagnosis of conditions or diseases characterized by expression of hGDMLP-1, or in assays to monitor patients being treated with hGDMLP-1, agonists, antagonists or inhibitors. The antibodies useful for diagnostic purposes can be prepared in the same manner as those described above for therapeutics. Diagnostic assays for hGDMLP-1 include methods which utilize the antibody and a label to detect hGDMLP-1 in human body fluids or extracts of cells or tissues. The antibodies may be used with or without modification, and may be labeled by joining them, either covalently or non-covalently, with a reporter molecule. A wide variety of reporter molecules which are known in the art may be used, several of which are described above.

A variety of protocols including ELISA, RIA, and fluorescence-activated cell sorting (FACS) for measuring hGDMLP-1 are known in the art and provide a basis for diagnosing altered or abnormal levels of hGDMLP-1 expression. Normal or standard values for hGDMLP-1 expression are established by combining body fluids or cell extracts taken from normal mammalian subjects, preferably human, with antibody to hGDMLP-1 under conditions suitable for complex formation. The amount of standard complex formation may be quantified by various methods, but preferably by photometric means. Quantities of hGDMLP-1 expressed in subject, control, and disease samples from biopsied tissues are compared with the standard values. Deviation between standard and subject values establishes the parameters for diagnosing disease.

In another embodiment of the invention, the polynucleotides encoding hGDMLP-1 can be used for diagnostic purposes. The polynucleotides which can be used include oligonucleotide sequences, complementary RNA and DNA molecules, and PNAs. The polynucleotides may be used to detect and quantitate gene expression in biopsied tissues in which expression of hGDMLP-1 may be correlated with disease. The diagnostic assay may be used to distinguish between absence, presence, and excess expression of hGDMLP-1, and to monitor regulation of hGDMLP-1 levels during therapeutic intervention.

In one aspect, hybridization with PCR probes which are capable of detecting polynucleotide sequences, including genomic sequences, encoding hGDMLP-1 or closely related molecules, may be used to identify nucleic acid sequences which encode hGDMLP-1. The specificity of the probe, whether it is made from a highly specific region, e.g., 10 unique nucleotides in the 5' regulatory region, or a less specific region, e.g., especially in the 3' coding region, and the stringency of the hybridization or amplification (maximal, high, intermediate, or low) will determine whether the probe identifies only naturally occurring sequences encoding hGDMLP-1, alleles, or related sequences.

Probes may also be used for the detection of related sequences, and should preferably contain at least 50% of the nucleotides from any of the hGDMLP-1 encoding sequences. The hybridization probes of the subject invention may be DNA or RNA and derived from the nucleotide sequence of SEQ ID NO:1, or from genomic sequence including promoter, enhancer elements, and introns of the naturally occurring hGDMLP-1 (SEQ ID NO:3).

Means for producing specific hybridization probes for DNAs encoding hGDMLP-1 include the cloning of nucleic acid sequences encoding hGDMLP-1 or hGDMLP-1 derivatives into vectors for the production of mRNA probes. Such vectors are known in the art, commercially available, and may be used to synthesize RNA probes in vitro by means of the addition of the appropriate RNA polymerases and the appropriate labeled nucleotides. Hybridization probes may be labeled by a variety of reporter groups, for example, radionuclides such as 32P or 35S, or enzymatic labels, such as alkaline phosphatase coupled to the probe via avidin/biotin coupling systems, and the like.

Polynucleotide sequences encoding hGDMLP-1 may be used for the diagnosis of a disorder associated with expression of hGDMLP-1, in particular heart and skeletal muscle disorders.

The polynucleotide sequences encoding hGDMLP-1 may be used in Southern or northern analysis, dot blot, or other membrane-based technologies; in PCR technologies; or in dipstick, pin, ELISA assays or microarrays utilizing fluids or tissues from patient biopsies to detect altered hGDMLP-1 expression. Such qualitative or quantitative methods are well known in the art.

The nucleotide sequences encoding hGDMLP-1 may be labeled by standard methods, and added to a fluid or tissue sample from a patient under conditions suitable for the formation of hybridization complexes. After a suitable incubation period, the sample is washed and the signal is quantitated and compared with a standard value. If the amount of signal in the biopsied or extracted sample is significantly altered from that of a comparable control sample, the nucleotide sequences have hybridized with nucleotide sequences in the sample, and the presence of altered levels of nucleotide sequences encoding hGDMLP-1 in the sample indicates the presence of the associated disease. Such assays may also be used to evaluate the efficacy of a particular therapeutic treatment regimen in animal studies, in clinical trials, or in monitoring the treatment of an individual patient.

In order to provide a basis for the diagnosis of disease associated with expression of hGDMLP-1, a normal or standard profile for expression is established. This may be accomplished by combining body fluids or cell extracts taken from normal subjects, either animal or human, with a sequence, or a fragment thereof, which encodes hGDMLP-1, under conditions suitable for hybridization or amplification. Standard hybridization may be quantified by comparing the values obtained from normal subjects with those from an experiment where a known amount of a substantially purified polynucleotide is used. Standard values obtained from normal samples may be compared with values obtained from samples from patients who are symptomatic for disease. Deviation between standard and subject values is used to establish the presence of disease.

Once disease is established and a treatment protocol is initiated, hybridization assays may be repeated on a regular basis to evaluate whether the level of expression in the patient begins to approximate that which is observed in the normal patient. The results obtained from successive assays may be used to show the efficacy of treatment over a period ranging from several days to months.

With respect to cancer, the presence of a relatively high amount of transcript in biopsied tissue from an individual may indicate a predisposition for the development of the disease, or may provide a means for detecting the disease prior to the appearance of actual clinical symptoms. A more definitive diagnosis of this type may allow health professionals to employ preventative measures or aggressive treatment earlier thereby preventing the development or further progression of the cancer.

Additional diagnostic uses for oligonucleotides designed from the sequences encoding hGDMLP-1 may involve the use of PCR. Such oligomers may be chemically synthesized, generated enzymatically, or produced in vitro. Oligomers will preferably consist of two nucleotide sequences, one with sense orientation and another with antisense, employed under optimized conditions for identification of a specific gene or condition. The same two oligomers, nested sets of oligomers, or even a degenerate pool of oligomers may be employed under less stringent conditions for detection and/ or quantitation of closely related DNA or RNA sequences.

Methods which may also be used to quantitate the expression of hGDMLP-1 include radiolabeling or biotinylating nucleotides, coamplification of a control nucleic acid, and standard curves onto which the experimental results are interpolated (Melby, P. C. et al. (1993) J. Immunol. Methods, 159:235–244; Duplaa, C. et al. (1993) Anal. Biochem. 229–236). The speed of quantitation of multiple samples may be accelerated by running the assay in an ELISA format where the oligomer of interest is presented in various dilutions and a spectrophotometric or calorimetric response gives rapid quantitation.

In further embodiments, an oligonucleotide derived from any of the polynucleotide sequences described herein may be used as a target in a microarray. The microarray can be used to monitor the expression level of large numbers of genes simultaneously (to produce a transcript image), and to identify genetic variants, mutations and polymorphisms. This information will be useful in determining gene function, understanding the genetic basis of disease, diagnosing disease, and in developing and monitoring the activity of therapeutic agents (Heller, R. et al. (1997) Proc. Natl. Acad. Sci. 94:2150–55).

In one embodiment, the microarray is prepared and used according to the methods described in PCT application WO95/11995 (Chee et al.), Lockhart, D. J. et al. (1996; Nat. Biotech. 14: 1675–1680) and Schena, M. et al. (1996; Proc. Natl. Acad. Sci. 93: 10614–10619), all of which are incorporated herein in their entirety by reference.

The microarray is preferably composed of a large number of unique, single-stranded nucleic acid sequences, usually either synthetic antisense oligonucleotides or fragments of cDNAs, fixed to a solid support. The oligonucleotides are preferably about 6–60 nucleotides in length, more preferably 15–30 nucleotides in length, and most preferably about 20–25 nucleotides in length. For a certain type of microarray, it may be preferable to use oligonucleotides which are only 7–10 nucleotides in length. The microarray may contain oligonucleotides which cover the known 5' or 3' sequence, sequential oligonucleotides which cover the full length sequence, or unique oligonucleotides selected from particular areas along the length of the sequence. Polynucleotides used in the microarray may be oligonucleotides that are specific to a gene or genes of interest in which at least a fragment of the sequence is known or that are specific to one or more unidentified cDNAs which are common to a particular cell type, developmental or disease state.

In order to produce oligonucleotides to a known sequence for a microarray, the gene of interest is examined using a computer algorithm which starts at the 5', or more preferably, at the 3' end of the nucleotide sequence. The algorithm identifies oligomers of defined length that are unique to the gene, have a GC content within a range suitable for hybridization, and lack predicted secondary structure that may interfere with hybridization. In certain situations it may be appropriate to use pairs of oligonucleotides on a microarray. The "pairs" will be identical, except for one nucleotide which preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process. The substrate may be paper, nylon or other type of membrane, filter, chip, glass slide or any other suitable solid support.

In another aspect, an oligonucleotide may be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536 or 6144 oligonucleotides, or any other number between two and one million which lends itself to the efficient use of commercially available instrumentation.

In order to conduct sample analysis using a microarray, the RNA or DNA from a biological sample is made into hybridization probes. The mRNA is isolated, and cDNA is produced and used as a template to make antisense RNA (aRNA). The aRNA is amplified in the presence of fluorescent nucleotides, and labeled probes are incubated with the microarray so that the probe sequences hybridize to complementary oligonucleotides of the microarray. Incubation conditions are adjusted so that hybridization occurs with precise complementary matches or with various degrees of less complementarity. After removal of nonhybridized probes, a scanner is used to determine the levels and patterns of fluorescence. The scanned images are examined to determine degree of complementarity and the relative abundance of each oligonucleotide sequence on the microarray. The biological samples may be obtained from any bodily fluids (such as blood, urine, saliva, phlegm, gastric juices, etc.), cultured cells, biopsies, or other tissue preparations. A detection system may be used to measure the absence, presence, and amount of hybridization for all of the distinct sequences simultaneously. This data may be used for large scale correlation studies on the sequences, mutations, variants, or polymorphisms among samples.

In another embodiment of the invention, the nucleic acid sequences which encode hGDMLP-1 may also be used to generate hybridization probes which are useful for mapping the naturally occurring genomic sequence. The sequences may be mapped to a particular chromosome, to a specific region of a chromosome or to artificial chromosome constructions, such as human artificial chromosomes (HACs), yeast artificial chromosomes (YACs), bacterial artificial chromosomes (BACs), bacterial P1 constructions or single chromosome cDNA libraries as reviewed in Price, C. M. (1993) Blood Rev. 7:127–134, and Trask, B. J. (1991) Trends Genet. 7:149–154.

Fluorescent in situ hybridization (FISH as described in Verma et al. (1988) Human Chromosomes: A Manual of Basic Techniques, Pergamon Press, New York, N.Y.) may be correlated with other physical chromosome mapping techniques and genetic map data. Examples of genetic map data can be found in various scientific journals or at Online Mendelian Inheritance in Man (OMIM). Correlation between the location of the gene encoding hGDMLP-1 on a physical chromosomal map and a specific disease, or predisposition to a specific disease, may help delimit the region of DNA associated with that genetic disease. The nucleotide sequences of the subject invention may be used to detect differences in gene sequences between normal, carrier, or affected individuals.

In situ hybridization of chromosomal preparations and physical mapping techniques such as linkage analysis using established chromosomal markers may be used for extending genetic maps. Often the placement of a gene on the chromosome of another mammalian species, such as mouse, may reveal associated markers even if the number or arm of a particular human chromosome is not known. New sequences can be assigned to chromosomal arms, or parts thereof, by physical mapping. This provides valuable information to investigators searching for disease genes using positional cloning or other gene discovery techniques. Once the disease or syndrome has been crudely localized by genetic linkage to a particular genomic region, for example, AT to 11q22-23 (Gatti, R. A. et al. (1988) Nature 336:577–580), any sequences mapping to that area may represent associated or regulatory genes for further investigation. The nucleotide sequence of the subject invention may also be used to detect differences in the chromosomal location due to translocation, inversion, etc. among normal, carrier, or affected individuals.

In another embodiment of the invention, hGDMLP-1, its catalytic or immunogenic fragments or oligopeptides thereof, can be used for screening libraries of compounds in any of a variety of drug screening techniques. The fragment employed in such screening may be free in solution, affixed to a solid support, borne on a cell surface, or located intracellularly. The formation of binding complexes, between hGDMLP-1 and the agent being tested, may be measured.

Another technique for drug screening which may be used provides for high throughput screening of compounds having suitable binding affinity to the protein of interest as described in published PCT application WO84/03564. In this method, as applied to hGDMLP-1 large numbers of different small test compounds are synthesized on a solid substrate, such as plastic pins or some other surface. The test compounds are reacted with hGDMLP-1, or fragments thereof, and washed. Bound hGDMLP-1 is then detected by methods well known in the art. Purified hGDMLP-1 can also be coated directly onto plates for use in the aforementioned drug screening techniques. Alternatively, non-neutralizing antibodies can be used to capture the peptide and immobilize it on a solid support.

In another embodiment, one may use competitive drug screening assays in which neutralizing antibodies capable of binding hGDMLP-1 specifically compete with a test compound for binding hGDMLP-1. In this manner, the antibodies can be used to detect the presence of any peptide which shares one or more antigenic determinants with hGDMLP-1.

In additional embodiments, the nucleotide sequences which encode hGDMLP-1 may be used in any molecular biology techniques that have yet to be developed, provided the new techniques rely on properties of nucleotide sequences that are currently known, including, but not limited to, such properties as the triplet genetic code and specific base pair interactions.

The following examples are provided by way of illustration and not by way of limitation.

EXAMPLE 1

Identification and Characterization of a cDNA Encoding a Novel Human Genome-derived Myosin-like Gene In order to identify novel human genes that predispose or contribute to diseases caused by perturbations of the cellular contractile apparatus, we undertook to mine human genomic DNA for exons particularly expressed in human cardiac and/or skeletal muscle, looking in particular for those that are part of genes that have proven refractory to prior identification efforts based upon cloning and/or sequencing of expressed transcripts.

Briefly, bioinformatic algorithms were applied to human genomic sequence data to identify putative exons. Each of the predicted exons was amplified from genomic DNA, typically centering the putative coding sequence within a larger amplicon that included flanking noncoding sequence. These genome-derived single exon probes were arrayed on a solid support and expression of the bioinformatically predicted exons assessed through a series of simultaneous two-color hybridizations to the genome-derived single exon microarrays. The approach and procedures are further described in detail in Penn et al., "Mining the Human Genome using Microarrays of Open Reading Frames," Nature Genetics 26:315–318 (2000); commonly owned and copending U.S. patent application Ser. No. 09/774,203, filed Jan. 29, 2001; and commonly owned and copending U.S. provisional patent application No. 60/207,456, filed May 26, 2000, No. 60/234,687, filed Sep. 21, 2000, and No. 60/236,359, filed Sep. 27, 2000, the disclosures of which are incorporated herein by reference in their entireties.

Using a graphical display particularly designed to facilitate computerized query of the resulting exon-specific expression data, as further described in commonly owned and copending U.S. patent application Ser. No. 09/774,203, filed Jan. 29, 2001, an exon was identified that is expressed at high levels in human heart but in none of nine other tested tissues or cell types.

FIG. 1 is a screen shot of the graphical display in which the heart-specific exon is, for purpose of exemplification, centered in the view pane. A black line, demarcated at regular intervals in megabases ("Mb"), represents a continuous stretch of human chromosome 22 ("genome sequence line"). Below the line, in a horizontal field labeled "amp", are rectangles (blue in the original display) that identify regions of chromosome 22 that were, in one or another experiment, amplified from genomic DNA. The rectangles are aligned with the genome sequence line to show the starting and ending nucleotides of the amplicons.

Moving downward in the view pane, horizontal fields are presented that show expression measured for various of the amplicons in human heart ("HEA"), brain ("BRA"), adult liver ("ADU"), HeLa cells ("HEL"), lung ("LUN"), fetal liver ("FET"), HBL100 cells ("HBL"), bone marrow ("BON"), BT4 cells ("BT4"), and placenta ("PLA"). As further described in commonly owned and copending U.S. patent application Ser. No. 09/774,203, the expression relative to control (here a pool of message from 10 tissues) is shown in the original display in shades of red and green, with green indicating expression greater than control.

As can be seen in FIG. 1, the exon centered at about 11.1052 Mb is expressed at levels above control solely (among the tested tissues and cell types) in human heart, meeting our inclusion criteria for further study.

Standard RACE (rapid amplification of cDNA ends) and RT-PCR (reverse transcription polymerase chain reaction) techniques were used to obtain overlapping cDNA clones that collectively span 8,166 nucleotides and appear to contain the entire coding region of the gene. RT-PCR and RACE techniques are described, inter alia, in Siebert et al. (eds.), *Gene Cloning and Analysis by RT-PCR*, Eaton Publishing Company/Bio Techniques Books Division, 1998 (ISBN: 1881299147); Schaefer, *Anal. Biochem.* 20:227(2):255–73 (1995); Ausubel et al. (eds.), *Short Protocols in Molecular Biology: A Compendium of Methods from Current Protocols in Molecular Biology*, 4$^{th}$ edition (April 1999), John Wiley & Sons (ISBN: 047132938X) and Sambrook et al. (eds.), *Molecular Cloning: A Laboratory Manual* (3$^{rd}$ ed.), Cold Spring Harbor Laboratory Press (2000) (ISBN: 0879695773), the disclosures of which are incorporated herein by reference in their entireties. The cDNA was sequenced on both strands using a MegaBace™ sequencer (Molecular Dynamics, Inc., Sunnyvale, Calif., USA).

FIGS. 2A–2L collectively present the sequence of the cDNA (SEQ ID NO:1) and its translation (SEQ ID NO:3). For reasons set forth below, we have denominated the novel gene hGDMLP-1.

The hGDMLP-1 cDNA spans 8166 nucleotides and contains an open reading frame from nucleotide 170 through and including nt 7876, predicting a protein of 2568 amino acids (285.3 kD absent post-translational modification). The clone appears full length, with the reading frame opening with a methionine and terminating with a stop codon before a 3' poly-A tail.

Structurally, the N-terminal 600 amino acids, as well as the C-terminal 1100 amino acids (1400–2568) are quite hydrophilic, with fully one third of the amino acids of the first 480 residues strongly acidic or basic.

Motif searches using Pfam (Washington University, St. Louis, web site), SMART (European Molecular Biology Laboratory, Heidelberg, web site), and PROSITE pattern and profile databases (Expert Protein Analysis System (ExPASy) web site), identified several known domains. A myosin head (also denominated myosin motor, large ATPase) domain is encoded by amino acid residues 566–1335; a myosin tail domain is located at residues 1422–1919. Given the presence of a myosin head and a myosin tail, we have denominated the gene "human genome-derived myosin-like protein-1" ("hGDMLP-1").

In addition to myosin head and myosin tail domains, SMART and Pfam both additionally identified an IQ domain at residues 1336–1358. The IQ domain is a short calmodulin-binding motif containing conserved Ile and Gln residues, suggesting interaction of hGDMLP-1 with calmodulin, which is known to serve as the light chain for myosins I and V.

The sequence of the hGDMLP-1 cDNA was used a BLAST query into the GenBank nr and dbEst databases. The nr database includes all non-redundant GenBank coding sequence translations, sequences derived from the 3-dimensional structures in the Brookhaven Protein Data Bank (PDB), sequences from SwissProt, sequences from the protein information resource (PIR), and sequences from protein research foundation (PRF). The dbEst (database of expressed sequence tags) includes ESTs, short, single pass read cDNA (mRNA) sequences, and cDNA sequences from differential display experiments and RACE experiments.

A number of ESTs showing strong sequence similarity to short regions of the hGDMLP-1 coding sequence were identified, as was an EST identical to exons 15 and 16 of hGDMLP-1 (EST accession no. AA993492: "ot64g05.s1 Soares_testis_NHT Homo sapiens cDNA clone IMAGE:1621592 3' similar to TR:Q92614 Q92614 MYELOBLAST KIAA0216. ;, mRNA") (spanning nt 2954–3174 according to numbering in SEQ ID NO:1).

Nonetheless, hGDMLP-1 has not previously been identified as a full length clone. Two full length genes prior-accessioned into GenBank do, however, appear to be closely related.

The first is a murine myosin gene containing a PDZ domain (mysPDZ) (GenBank accession no. BAA93660), further described by Furusawa et al., "Isolation of a novel PDZ-containing myosin from hematopoietic supportive bone marrow stromal cell lines," *Biochem. Biophys. Res. Commun.* 270(1):67–75 (2000), the disclosure of which is incorporated herein by reference in its entirety. In the region of greatest similarity—residues 477–2270 of hGDMLP-1—hGDMLP-1 and BAA93660 show 40% identity and 60% similarity at the amino acid level, with similarity scored according to the NCBI BLAST standard BLOSUM matrix (Henikoff et al., *Proc. Natl. Acad. Sci. USA* 89:10915–10919 (1992); Henikoff et al., *Proteins* 17:49–61 (1993)). This region includes both the hGDMLP myosin head domain and myosin tail domain.

hGDMLP-1 is also highly similar across the same region (residues 477–2270 of hGDMLP-1) to the human orthologue of the murine PDZ-containing myosin in mouse (accession no. BAA13206), showing 40% identity and 61% similarity to hGDMLP-1 at the amino acid level.

FIGS. 3A–3C collectively show a multiple sequence alignment of hGDMLP-1 (amino acid residues 505–2249) with BAA93660 (murine PDZ-containing myosin-like gene, residues 341–2035) and BAA13206 (human myosin heavy chain-like gene containing P-loop, residues 1–1581). Gaps are shown within a sequence as one or more dashes (-). In the consensus line underlying the three aligned sequences, "*" indicates residues that are identical or conserved in all sequences in the alignment, ":" indicates conserved substitutions, and "."=indicates semi-conserved substitutions.

Further directed comparison of hGDMLP-1 with 10 other proteins previously identified to be myosin or myosin-like confirms that hGDMLP-1 is most similar in sequence to mysPDZ. Significant similarity was also detected to human (but not murine) myocilin (myoC). FIG. 4 shows pairwise alignment of hGDMLP-1 to human myocilin (myoC). As shown, in the region of maximal similarity in amino acid sequence, 28% of residues are identical; 54% of residues are similar, with similarity scored according to the BLOSUM 62 matrix.

Both mysPDZ and myoC are cytoskeleton-associated proteins. MyoC is associated with glaucoma, has a secreted form, and is found in association with cilia in photoreceptor cells. Based upon these sequence similarities, hGDMLP-1 is a myosin-like protein that is cytoskeleton-associated.

Separately querying GenBank with sequence drawn from the hydrophilic N-terminus and C-terminus of hGDMLP-1, the N-terminal region (112–515) is seen to have some sequence similarity to collagen alpha and other hydrophilic proteins (such as cylicin and neurofilament triplet H protein), whereas the C-terminal end of the protein is unique.

EXAMPLE 2

Identification and Characterization of a Genomic Region Encoding hGDMLP-1

Figure 5:
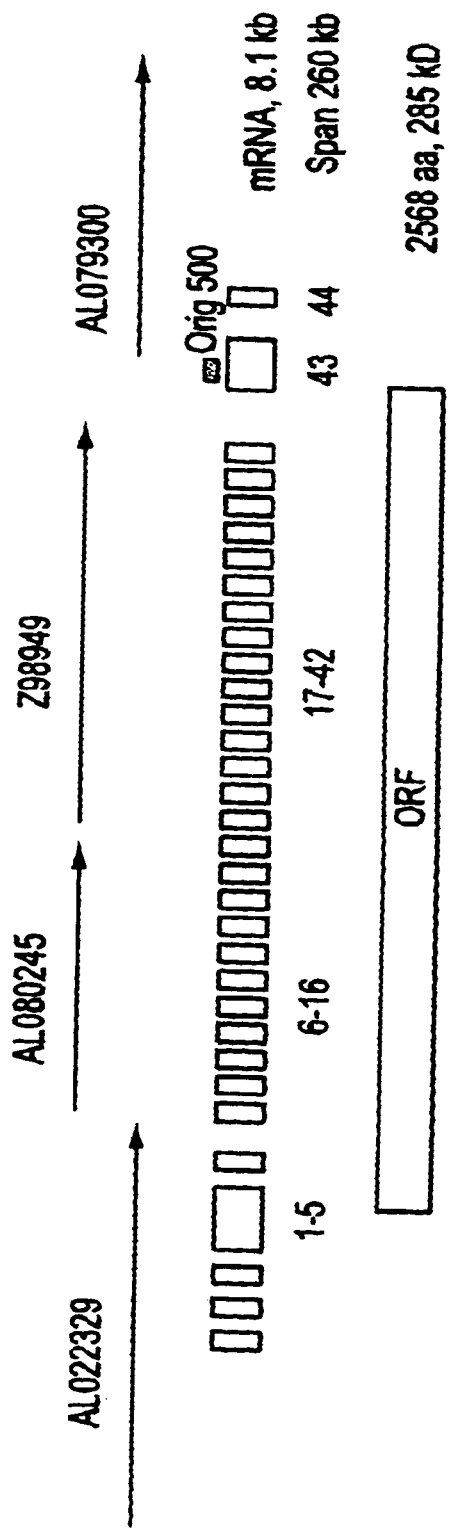
FIG. 5 schematizes the genomic organization of the hGDMLP-1 gene, showing the relative location and size of the 44 exons of the protein and their relationship to the genomic clones (BACs) and cDNA open reading frame.

BLAST query of genomic sequence identified four BACs that constitute the minimum set of clones encompassing the cDNA sequence (FIG. 5).

Based upon the known origin of the four BACs (AL022329, AL080245, Z98949 and AL079300) that encompass hGDMLP-1, the gene can be mapped to human chromosome 22q11.2, about 1 Mb distal to the 22q11 low copy repeat region.

Comparison of the cDNA and genomic sequences identified 44 exons, occupying a 288 kb region on chromosome 22q11.2. Exon organization is listed in Table 1.

TABLE I hGDMLP-1 Exon Structure

| Exon no. | cDNA range | genomic range | BAC accession |
|---|---|---|---|
| 1 | 1–60 | 192976–193035 | AL022329.9 |
| 2 | 61–208 | 211726–211873 | |
| 3 | 209–367 | 213973–214131 | |
| 4 | 368–1681 | 218857–220170 | |
| 5 | 1682–1748 | 220852–220918 | |
| 6 | 1749–1861 | 206–318 | AL080245.14 |
| 7 | 1862–2038 | 1668–1844 | |
| 8 | 2039–2237 | 6917–7115 | |
| 9 | 2238–2380 | 9390–9532 | |
| 10 | 2381–2481 | 11068–11168 | |
| 11 | 2482–2545 | 14762–14825 | |
| 12 | 2546–2690 | 27287–27431 | |
| 13 | 2691–2864 | 52839–53012 | |
| 14 | 2865–2955 | 55743–55833 | |
| 15 | 2956–3148 | 58110–58302 | |
| 16 | 3149–3229 | 62251–62331 | |
| 17 | 3230–3380 | 560–710 | Z98949.1 |
| 18 | 3381–3540 | 9002–9161 | |
| 19 | 3541–3724 | 11367–11550 | |
| 20 | 3725–3947 | 12697–12919 | |
| 21 | 3948–4057 | 16737–16846 | |
| 22 | 4058–4123 | 33587–33652 | |
| 23 | 4124–4252 | 39553–39681 | |
| 24 | 4253–4396 | 41456–41599 | |
| 25 | 4397–4486 | 43226–43315 | |
| 26 | 4487–4606 | 56023–56142 | |
| 27 | 4607–4715 | 56571–56679 | |
| 28 | 4716–4840 | 60423–60547 | |
| 29 | 4841–4995 | 63574–63728 | |
| 30 | 4996–5119 | 67880–68003 | |
| 31 | 5120–5320 | 68898–69098 | |
| 32 | 5321–5431 | 73589–73699 | |
| 33 | 5432–5536 | 76213–76317 | |
| 34 | 5537–5689 | 86524–86676 | |
| 35 | 5690–5803 | 111403–111516 | |
| 36 | 5804–5920 | 112978–113094 | |
| 37 | 5921–6004 | 115633–115716 | |
| 38 | 6005–6142 | 117552–117689 | |
| 39 | 6143–6328 | 120445–120630 | |
| 40 | 6329–6459 | 157629–157759 | |
| 41 | 6460–6504 | 168531–168575 | |
| 42 | 6505–6642 | 169984–170121 | |
| 43 | 6643–7888 | 18298–19543 | AL079300.11 |
| 44 | 7889–8090 | 22296–22497 | |

EXAMPLE 3

Expression and Transcription Control of hGDMLP-1

Exons 1, 3, 4, 7, 8, 9, 15, 20, 24, 31, 39, 43, and 44 of hGDMLP-1 were separately amplified and the genome-derived single-exon probes arrayed for expression analysis essentially as described in Penn et al., "Mining the Human Genome using Microarrays of Open Reading Frames," *Nature Genetics* 26:315–318 (2000) and commonly owned and copending U.S. patent application Ser. No. 09/774,203, filed Jan. 29, 2001, the disclosures of which are incorporated herein by reference in their entireties.

Table 2 reports the results of hybridization experiments. "Amplicon" is a unique designation. "Signal" indicates normalized signal intensity. "Ratio" is the ratio of expression relative to control. "ND" indicates "not determined".

TABLE 2

| | $Amp_{13}$ 2534, exon 1 | | $Amp_{13}$ 2541, exon 3 | | $Amp_{13}$ 2540, exon 3 | | $Amp_{13}$ 38, exon 4 | | $Amp_{13}$ 10400, exon 4 | | $Amp_{13}$ 11966, exon 4 | |
|---|---|---|---|---|---|---|---|---|---|---|---|---|
| | SIGNAL | RATIO | SIGNAL | RATIO | SIGNAL | RATIO | SIGNAL | RATIO | SIGNAL | RATIO | SIGNAL | RATIO |
| ADRENAL | 0.71 | 1.43 | 0.94 | | 0.7 | 1.15 | 4.12 | | ND | ND | ND | ND |
| ADULT LIVER | 0.52 | 1.13 | 0.46 | | 0.59 | 1.11 | 6.54 | −1.28 | 1.56 | | 2.41 | |
| BONE MARROW | 0.71 | | 0.77 | | 0.95 | | | −1.29 | 1.77 | −1.15 | 2.35 | 1.08 |
| BRAIN | 0.52 | −1.06 | | | 0.83 | −1.37 | | −1.58 | 1.8 | −1.15 | 1.75 | −1.23 |
| FETAL LIVER | 0.49 | | 0.47 | 1.29 | 0.72 | 1.06 | | −1.3 | 1.49 | | 2.47 | −1.28 |
| HEART | 1.86 | 3.33 | 2.01 | 3.13 | 2.52 | 2.77 | 6.23 | −1.05 | 2.9 | 1.36 | 3.16 | −1.02 |
| HELA | 0.71 | | 0.72 | −1.02 | 0.82 | 1.03 | 6.08 | −1.11 | 1.91 | 1.11 | 2.07 | −1.01 |
| KIDNEY | 0.61 | −1.11 | 0.66 | 1.01 | 0.81 | | 6.71 | −1.09 | ND | ND | ND | ND |
| LUNG | 0.66 | −1.2 | 0.73 | −1.06 | 0.83 | −1.02 | 7.15 | −1.02 | 0.99 | −1.38 | 1.95 | −1.05 |
| PLACENTA | 0.46 | | 0.55 | 2.59 | 0.57 | | | | 2.09 | 1.02 | 2.2 | −1.12 |
| PROSTATE | 0.26 | | 0.58 | −1.11 | 0.58 | 1.15 | | −1.16 | ND | ND | ND | ND |
| SKELKTAL MUSCLE | 9.61 | 6.61 | 3.38 | 5.14 | 4.04 | | 8.12 | 1.04 | ND | ND | ND | ND |

TABLE 2-continued

| | Amp₁₃ 33835, exon 7 | | Amp₁₃ 9715, exon 7 | | Amp₁₃ 73301, exon 8 | | Amp₁₃ 73302, exon 9 | | Amp₁₃ 33836, exon 15 | | Amp₁₃ 10252, exon 15 | |
|---|---|---|---|---|---|---|---|---|---|---|---|---|
| | SIGNAL | RATIO | SIGNAL | RATIO | SIGNAL | RATIO | SIGNAL | RATIO | SIGNAL | RATIO | SIGNAL | RATIO |
| ADRENAL | 2.72 | −1.72 | ND | ND | 0.87 | −1.02 | 3.43 | 1.22 | 0.84 | 1.3 | ND | ND |
| ADULT LIVER | 3.32 | −1.76 | 2.88 | | 1.14 | −1.27 | 3.88 | 1.21 | | 1.22 | 1.28 | |
| BONE MARROW | 2.53 | −1.85 | 2.99 | −1.22 | 0.79 | | 3.68 | 1.06 | 0.64 | 1.34 | 1.68 | −1.1 |
| BRAIN | 2.46 | −1.61 | 3.92 | 1.09 | 0.66 | −1.29 | 4.28 | 1.57 | 0.67 | 1.32 | 1.86 | −1.08 |
| FETAL LIVER | 2.39 | −1.77 | 3.14 | −1.2 | 0.89 | 1.08 | 4.28 | 1.33 | 0.78 | 1.5 | 1.31 | −1.27 |
| HEART | 2.13 | −2.04 | 3.05 | −1.18 | 1.38 | | 3.19 | −1.09 | | 1.75 | 1.9 | 1.26 |
| HELA | 2.71 | −1.65 | 3.05 | −1.17 | 0.89 | −1.12 | 3.45 | 1.03 | 0.64 | | 1.36 | −1.09 |
| KIDNEY | 2.79 | −1.85 | ND | ND | 1.22 | 1.11 | 3.99 | 1.03 | 0.71 | −1.09 | ND | ND |
| LUNG | 2.97 | −1.82 | 2.59 | −1.15 | 0.9 | −1.13 | 3.83 | 1.33 | 0.71 | | 1.03 | −1.33 |
| PLACENTA | 2.98 | −1.69 | 3.19 | −1.05 | 1.14 | | 4.1 | 1.29 | 0.84 | 1.09 | 1.37 | −1.23 |
| PROSTATE | 2.89 | −1.39 | ND | ND | 0.97 | 1.05 | 3.89 | 1.38 | 0.75 | | ND | ND |
| SKELETAL MUSCLE | 2.14 | −1.97 | ND | ND | 2.49 | 2.04 | 3.08 | −1.04 | | | ND | ND |

| | Amp₁₃ 92329, exon 20 | | Amp₁₃ 92328, exon 24 | | Amp₁₃ 92327, exon 31 | | Amp₁₃ 92326, exon 39 | | Amp₁₃ 40, exon 43 | | Amp₁₃ 5271, exon 43 | |
|---|---|---|---|---|---|---|---|---|---|---|---|---|
| | SIGNAL | RATIO | SIGNAL | RATIO | SIGNAL | RATIO | SIGNAL | RATIO | SIGNAL | RATIO | SIGNAL | RATIO |
| ADRENAL | 0.59 | 1.34 | 3.96 | 1.3 | 0.46 | | 2.14 | 1.01 | | | ND | ND |
| ADULT LIVER | 0.63 | 1.56 | 6.05 | 1.54 | 0.44 | 2.83 | 2.67 | 1.06 | 0.82 | | 0.56 | −1.22 |
| BONE MARROW | 0.5 | | | 1.34 | | | 2.05 | −1.15 | | | 0.42 | −3.09 |
| BRAIN | | | | | 0.46 | | 2.1 | 1.15 | 0.99 | 1.28 | 0.44 | 1.13 |
| FETAL LIVER | 0.69 | 2.01 | 4.47 | 1.35 | 0.33 | | 2.01 | −1.08 | 0.72 | 1.07 | 0.48 | |
| HEART | 0.67 | 1.49 | 4.32 | 1.17 | | | 2.95 | 1.37 | | | | |
| HELA | 0.61 | 1.57 | 4.55 | 1.37 | 0.42 | | 2 | −1.05 | 0.9 | 1.08 | 0.39 | |
| KIDNEY | 0.65 | | 5.68 | 1.28 | 0.5 | | 3.55 | 1.15 | 0.99 | 1.34 | ND | ND |
| LUNG | 0.65 | 2.85 | 4.1 | 1.42 | 0.42 | | 2.09 | 1.09 | | 1.75 | 0.47 | −1.32 |
| PLACENTA | | | 3.59 | 1.4 | 0.48 | | 2.44 | −1.02 | 0.71 | 1.85 | 0.42 | −1.23 |
| PROSTATE | 0.67 | 1.41 | 3.07 | 1.43 | 0.49 | | 2.23 | 1.09 | 0.73 | | ND | ND |
| SKELETAL MUSCLE | 0.66 | | 3.95 | 1.26 | 0.69 | | 3.1 | 1.59 | 15.04 | | ND | ND |

| | Amp₁₃ 5272, exon 43 | | Amp₁₃ 5273, exon 43 | | Amp₁₃ 2920, exon 44 | |
|---|---|---|---|---|---|---|
| | SIGNAL | RATIO | SIGNAL | RATIO | SIGNAL | RATIO |
| ADRENAL | ND | ND | ND | ND | | 1.07 |
| ADULT LIVER | 0.55 | −1.48 | 0.57 | −2.46 | 1.3 | −1.34 |
| BONE MARROW | 0.54 | | 0.51 | −1.93 | 1.32 | −1.14 |
| BRAIN | 0.49 | | 0.48 | −4.19 | | −1.3 |
| FETAL LIVER | 0.53 | −1.64 | 0.78 | −3.56 | 1.2 | −1.5 |
| HEART | | 5.74 | | 6.44 | | |
| HELA | 0.52 | | 0.45 | | 1.13 | 1 |
| KIDNEY | ND | ND | ND | ND | 1.08 | −1.01 |
| LUNG | 0.67 | −1.04 | 0.65 | | | −1.14 |
| PLACENTA | 0.48 | 1.87 | | | | −1.36 |
| PROSTATE | ND | ND | ND | ND | | 1.44 |
| SKELETAL MUSCLE | ND | ND | ND | ND | 3.6 | |

ND = NOT DETERMINED

As can be seen in table 2, skeletal muscle and heart are the primary locations of hGDMLP-1 expression.

Heart and skeletal muscle-specific expression was further confirmed by northern blot analysis using amplicon 40 (exon 43) as probe. As shown in FIG. 6, of the 12 tissues assayed—blood, leukocytes, lung, placenta, small intestine, liver, kidney, spleen, thymus, colon, skeletal muscle, heart and brain—only skeletal muscle and heart demonstrate expression, with both having an 8 kb transcript.

Possession of the genomic sequence permitted search for promoter and other control sequences for the hGDMLP-1 gene.

A putative transcriptional control region, inclusive of promoter and downstream elements, was defined as 2 kb around the transcription start site, itself defined as the first nucleotide of the cDNA clone. The region, drawn from sequence of BAC AL022329, has the following sequence, where nucleotide number 1001 is the transcription start site:

(SEQ ID NO:15,752)
tgattttttttttttttttgagatggagtctctctctgtcaccc aggctggagtgcagtggcgcgatctcggcttactgcaagctccgc ctgtagctgggactacaggcgcccaccaccacgcccggctaattt tgtttttgtattttagtagagacggggtttcactgtgttagcca ggatggtctcaatctcctgacctcgtgatatgcccacctcggctt cccaaagtgccgggattacagacgtgagccaccgtgccaggccca aagcacttttttatagcccctagtttgctgttgtgtctgtttcct -continued

```
ctacggcccgcacagcctgggtttgaattctggctctccatggcc
ttgggcaagttggttaacttttttgtgtctcaatttccccacttgt
aaagtggggctggggaaaaaccctacctcatagggaacattaagt
gagttcatgaaagccctcggtgtgtggcatgcgataaccactacc
taagcataaggtatgtttacatgcactggttgtttaccacgacgc
accagcattcattcaagttattttcttccagagtctgcctggaat
gtagaaccggccagctctcctcotcaaacagttcctgcaacctct
ggttatctgtgtgggcagaggcgggagtgtgggtgtgtggccctg
ccctgggacagggatgacgagagagcatgtgcttgtgtccagagc
tgtccccttccctgctcagggggccaccaaatatgtccatggtctc
tgctgcctggtcaacggccacccccgggctgccgtctcctggccag
acctggagctcacaagctaattttagaaatgactggtcgactcag
ctgctgctatcacattggcccagaaggagggtgggggggaggacgg
gtcggggaggggcagtaagggggaagggatgtgtgtcggtgtgtgt
ggagagGGTGCTCCTTCGCTCCTGCTTTCCCGGCTCGGTGGGGTC
CCTTCGCGGCcacccggggagacgtcttagacagtcgtggttcct
gtgatctgtgtcctctttgcagaaggtactattgggctgggtttt
agacgggcaccttgcgagcggatcggcgagttttaattttccgga
atgogctgctgggggctgcggtggcaggcctccggtcttttggtc
tattttaggcctttctggtgttgagagcttccgaggcctgattcc
tttgcctgttgcccgtgctgctcactttgaaaacaagagtgtttc
ggtggaaggatttgagaacaaaatgctggggcaaatggacattcg
taagaatcactctcctcaggccccagctgttcgctaataatttt
aaaaatgtgtttagaatcatgagttaatctccactgtgaatcttt
gcccgcagacgtcagggtttatatttttcctcaactaccagtaat
ttctgcttcactggtgttcagttatggtcggggaagagccaggct
tcccctttcgtgttaacaacgctgttgagtcgaaatgttaatttt
aatgttcttttttaaactgcaaattaagcatgtatgagtgttggg
ggaagggcaatggaagttcatggctgaaggtttcaatttcatgcc
accttccttgagctctgtctgagggaaggtgtcttatctggcacc
ccggatagcaggcatttctctgaatgaagaagattcacaggtccc
agtggcccatagtggggcagaaggggggctatgctttgacatgga
gctctctcccaggagaggagaagacctcaccagctacaggcctct
gggctgctgccttcctgcagcttttccatggaggaggccaggagt
ggggaggcccggaatggggagcccagtcggctcccagtcggctcc
aagctgtccagtctggcctcaacccgcaagtgtgggggatctgggc
ttctatcctgtagggcctggaatacgacgaggctgttactttcac
tttgtggctgtccaaaaaga
```

Using PROSCAN, available at the National Institutes of Health web site, no significant promoter was identified in the putative promoter region. However, transcription factor binding sites were identified using MOTIF, available at the GenomeNet web site (Bioinformatics Center, Institute for Chemical Research, Kyoto University), including a SRY (sex-determining region Y gene product) binding sites (134. .140 bp, with numbering according to SEQ ID NO:15,752), and a couple of MZF1 (myeloid zinc finger 1, a negative regulator of CD34 and c-myb, and responsive to retinoic acid) binding sites (1843. .1850 bp and 403–395 bp).

EXAMPLE 4 hGDMLP-1 Disease Associations

Defects in hGDMLP-1 function and/or expression contribute to human disease. Predisposition to such diseases, presence of disease (diagnosis), and monitoring of the course of the disease can therefore be effected using the hGDMLP-1-specific diagnostic compositions and methods provided herein. Accordingly, treatment of such diseases can be effected using the hGDMLP-1-specific therapeutic compositions and methods provided herein.

Diseases that map to the hGDMLP-1 chromosomal region are shown in Table 3.

TABLE 3

Co-mapping Diseases

| OMIM No. | name | map location |
|----------|------|--------------|
| 115470 | cat eye syndrome | 22q11 |
| 217095 | conotruncal cardiac anomalies | 22q11 |
| 192430 | DiGeorge syndrome (2); Velocardiofacial syndrome | 22q11 |
| 604364 | Epilepsy, partial, with variable foci | 22q11–q12 |
| 600850 | Schizophrenia susceptibility locus, chromosome 22-related | 22q11–q13 |
| 155100 | May-Hegglin anomaly | 22q11.2 |
| 153640 | Fechtner syndrome | 22q11.2 |
| 605249 | Sebastian syndrome | 22q11.2 |
| 603622 | Deafness, autosomal dominant 17 | 22q11.2 |
| 145410 | Opitz G syndrome, type II | 22q11.2 |
| 601547 | Cataract, cerulean, type 2 | 22q11.2–q12.2 |

A number of these diseases have physiologic characteristics consistent with alteration of a myosin-like gene, especially a myosin-like gene particularly expressed in human heart.

Thus, the iris alterations that give cat eye syndrome (CES) its name are frequently associated with heart malformations. A small supernumerary chromosome (smaller than chromosome 21) is present, frequently has 2 centromeres, is bisatellited, and represents an inv dup(22)(q11). No gene candidates have been identified as yet.

Individuals with 22q11 deletion syndrome (del 22q11) have a range of findings, including congenital heart disease (74% of patients), particularly conotruncal malformations (tetralogy of Fallot, interrupted aortic arch, and truncus arteriosus); palatal abnormalities (69%), particularly velopharyngeal incompetence (VPI), submucosal cleft palate, and cleft palate; characteristic facial features (present in the majority of individuals); and learning difficulties (70–90%).

DiGeorge syndrome (DGS), most cases of which result from a deletion of chromosome 22q11.2, is characterized by hypocalcemia arising from parathyroid hypoplasia, thymic hypoplasia, and outflow tract defects of the heart. This syndrome has previously been considered to be a contiguous gene deletion, but one or a few genes in the identified locus may play a major role in the pathogenesis of the syndrome's characteristic phenotypic features. Several genes are lost in the characteristic deletion, but definitive identification of the causative genes is lacking.

Several disorders have been tentatively linked to another myosin-like gene that maps to 22q11, MYH9, although some of these associations are inferential and may be due instead to mutations in hGDMLP-1.

For example, the autosomal dominant giant-platelet disorders May-Hegglin anomaly, Fechtner syndrome, and Sebastian syndrome share the triad of thrombocytopenia, large platelets, and characteristic leukocyte inclusions. All three disorders may be allelic since May-Hegglin anomaly and Fechtner syndrome map to an overlapping region of 480 kb on chromosome 22. MYH9 was recently identified as a possible candidate gene, since MYH9 is expressed in platelets and is upregulated during granulocyte differentiation, but association of the disease with MYH9 is inferential. Kelley et al., *Nature Genetics* 26:106–108 (2000).

Other disorders that map to 22q11 may result from defects of hGDMLP-1, although primary disease manifestions are not in cardiac or skeletal muscle.

For example, Xiong et al., *Am. J. Hum. Genet.* 65:1698–1710 (1999), mapped the disease locus for a familial partial epilepsy syndrome with variable foci to an interval on 22q11-q12. The syndrome is characterized by mostly nocturnal seizures arising from frontal, temporal, and occasionally occipital epileptic foci. The syndrome is inherited as an autosomal dominant trait with incomplete penetrance.

Several studies have suggested that there may be a susceptibility locus for schizophrenia located on chromosome 22. Gill et al., *Am. J. Med. Genet.* 67:40–5 (1996). Additionally, Pulver et al. (1994) reported a higher incidence of schizophrenia among patients with velocardiofacial syndrome, which is localized to 22q11. Candidate genes have not yet been identified.

Opitz G syndrome, Opitz et al., *Birth Defects Orig. Art. Ser.* 2: 95–101 (1969), is characterized by hypertelorism or telecanthus; laryngotracheoesophageal cleft; clefts of lip, palate, and uvula; swallowing difficulty and hoarse cry; genitourinary defects, especially hypospadias in males and splayed labia majora in females; mental retardation; and congenital heart defects. Opitz Syndrome may also be characterized by additional abnormalities, including partial or complete closure of the anal opening (imperforate anus); hypoplasia or agenesis of the corpus callosum; renal abnormalities; heart defects; or mental retardation. Although Opitz G syndrome has been mapped to 22q11.2, no specific genes have been associated with the disease. See, e.g., Robin et al., *Am. J. Med. Genet.* 62: 305–317 (1996).

Congenital cataracts are responsible for between 10 and 30% of all cases of blindness in children. One of these congenital forms is cerulean cataract which has been mapped to 22q11.2-22q12.2. The beta-crystallin genes have been identified as possible candidate genes, but no definitive association has been shown.

In addition, diseases not yet shown to map to the hGDMLP-1 chromosomal locus will be shown to be attributable to hGDMLP-1 defects.

Diseases of the heart and vascular system are a significant cause of human morbidity and mortality. Increasingly, genetic factors are being found that contribute to predisposition, onset, and/or aggressiveness of most, if not all, of these diseases. Although mutations in single genes have on occasion been identified as causative, these disorders are for the most part believed to have polygenic etiologies.

For example, cardiovascular disease (CVD), which includes coronary heart disease, stroke, and peripheral arterial vascular disease, is the leading cause of death in the United States and other developed countries. In developing regions, coronary heart disease and stroke are ranked second and third, respectively, as causes of mortality. In the United States alone, about 1 million deaths (about 42% of total deaths per year) result from CVD each year. CVD is also a significant cause of morbidity, with about 1.5 million people suffering myocardial infarction, and about 500,000 suffering strokes in the United States each year. With risk for CVD increasing with age, and an increasingly aging population, CVD will continue to be a major health problem into the future.

CVD is caused by arterial lesions that begin as fatty streaks, which consist of lipid-laden foam cells, and develop into fibrous plaques. The atherosclerotic plaque may grow slowly, and over several decades may produce a severe stenosis or result in arterial occlusion. Some plaques are stable, but other, more unstable, ones may rupture and induce thrombosis. The thrombi may embolize, rapidly occluding the lumen and leading to myocardial infarction or acute ischemic syndrome.

Risk factors for CVD include age and gender. In addition, a family history of CVD significantly increases risk, indicating a genetic basis for development of this disease complex. Obesity, especially truncal obesity, the cause of which is suspected to be genetic, is yet another risk factor for CVD. Familial disorders such as hyperlipidemia, hypoalphalipoproteinemia, hypertriglyceridemia, hypercholesterolemia, hyperinsulinemia, homocystinuria, and dysbetalipoproteinemia, all of which lead to lipid or lipoprotein abnormalities, can predispose one to the development of CVD. Both insulin-dependent and non-insulin-dependent diabetes mellitus, both of which have genetic components, have been also linked to the development of atherosclerosis.

The literature is replete with evidence for genetic causes of cardiovascular diseases. For example, studies by Allayee et al., *Am. J. Hum. Genet.* 63:577–585(1998), indicated a genetic association between familial combined hyperlipidemia (FCHL) and small dense LDL particles. The studies also concluded that the genetic determinants for LDL particle size are shared, at least in part, among FCHL families and the more general population at risk for CVD. Juo et al., *Am. J. Hum. Genet.* 63: 586–594 (1998) demonstrated that small, dense LDL particles and elevated apolipoprotein B levels, both of which are commonly found in members of FCHL families, share a common major gene plus individual polygenic components. The common major gene was estimated to explain 37% of the variants of adjusted LDL particle size and 23% of the variants of adjusted apoB levels.

The atherogenic lipoprotein phenotype (ALP) is a common heritable trait, symptoms of which include a prevalence of small, dense LDL particles, increased levels of triglyceride-rich lipoproteins, reduced levels of high density lipoprotein, and increased risk of CVD, particularly myocardial infarction. Both Nishina et al., *Proc. Nat. Acad. Sci.* 89: 708–712 (1992) and Rotter et al., *Am. J. Hum. Genet.* 58: 585–594(1996) demonstrated linkage between ALP and the LDLR locus. Rotter et al., supra, also reported linkage to the CETP locus on chromosome 16 and to the SOD1 locus on chromosome 6, and possibly also to the APOA1/APOC3/APOA4 cluster on chromosome 11.

Mutations in genes identified as components of lipid metabolism, e.g., apolipoprotein E (apoE) and LDL receptor (LDLR), have been shown to be associated with predisposition to the development of CVD. For example, several apoE variants had been found to be associated with familial dysbetalipoproteinemia, characterized by elevated plasma cholesterol and triglyceride levels and an increased risk for atherosclerosis (de Knijff et al., *Mutat* 4: 178–194 (1994)). Mutations in the LDLR gene have been associated with the familial hypercholesterolemia, an autosomal dominant disorder characterized by elevation of serum cholesterol bound to low density lipoprotein (LDL), that can lead to increased susceptibility to CVD.

To date, mutations in numerous genes have been shown to be associated with increased CVD susceptibility. However, the identified genetic associations are believed not to account for all genetic contributions to CVD.

As yet another example, hypertension is a major health problem because of its high prevalence and its association with increased risk of CVD. Approximately 25% of all adults and over 60% of persons older than 60 years in the United States have high blood pressure.

Arterial or systemic hypertension is diagnosed when the average of two or more diastolic BP measurements on at least two subsequent visits is 90 mm Hg or more, or when the average of multiple systolic BP readings on two or more subsequent visits is consistently greater than 140 mm Hg. Pulmonary hypertension is defined as pressure within the pulmonary arterial system elevated above the normal range; pulmonary hypertension may lead to right ventricle (RV) failure.

Hypertension, together with other cardiovascular risk factors, leads to atherosclerosis and other forms of CVD, primarily by damaging the vascular endothelium. In more than 40% of the U.S. population, hypertension is accompanied by hyperlipidemia and leads to the development of atherosclerotic plaques. In the absence of hyperlipidemia, intimal thickening occurs. Non-atherosclerotic hypertension-induced vascular damage can lead to stroke or heart failure.

Familial diseases associated with secondary hypertension include familial renal disease, polycystic kidney disease, medullary thyroid cancer, pheochromocytoma, and hyperparathyroidism. Hypertension is also twice as common in patients with diabetes mellitus.

More than 95% of all hypertension cases are essential hypertension, that is, lack identifiable antecedent clinical cause. Essential hypertension shows clustering in families and can result from a variety of genetic diseases. In most cases, high blood pressure results from a complex interaction of factors with both genetic and environmental components. The recent search for genes that contribute to the development of essential hypertension has shown that the disorder is polygenic in origin. However, with several exceptions (such as angiotensinogen, angiotensin receptor-1, beta-3 subunit of guanine nucleotide-binding protein, tumor necrosis factor receptor-2, and α-adducin), the particular genes involved are still being sought.

Susceptibility loci for essential hypertension have been mapped to chromosomes 17 and 15q. Hasstedt et al., *Am. J. Hum. Genet.* 43: 14–22 (1988) measured red cell sodium in 1,800 normotensive members of 16 Utah pedigrees ascertained through hypertensive or normotensive probands, siblings with early stroke death, or brothers with early coronary disease, and suggested that red blood cell sodium was determined by 4 alleles at a single locus. This major locus was thought to explain 29% of the variance in red cell sodium, and polygenic inheritance explained another 54.6%.

A higher frequency of the high red blood cell sodium genotype in pedigrees in which the proband was hypertensive rather than normotensive provided evidence that this major locus increases susceptibility to hypertension.

From a study of systolic blood pressure in 278 pedigrees, Perusse et al., *Am. J. Hum. Genet.* 49: 94–105 (1991) reported that variability in systolic blood pressure is likely influenced by allelic variation of a single gene, with gender and age dependence. They also suggested that a single gene may be associated with a steeper increase of blood pressure with age among males and females.

There is strong evidence, however, for additional as yet uncharacterized, hypertension-associated loci on other chromosomes.

For example, Xu et al., *Am. J. Hum. Genet.* 64: 1694–1701 (1999) carried out a systematic search for chromosomal regions containing genes that regulate blood pressure by scanning the entire autosomal genome using 367 polymorphic markers. Because of the sampling design, the number of sib pairs, and the availability of genotyped parents, this study represented one of the most powerful of its kind. Although no regions achieved a 5% genomewide significance level, maximum lod scores were greater than 2.0 for regions of chromosomes 3, 11, 15, 16, and 17.

As another example, cardiac arrhythmias account for several thousand deaths each year. Arrhythmias such as ventricular fibrillation, which causes more than 300,000 sudden deaths annually in the United States alone, encompass a multitude of disorders. Another type of arrhythmia, idiopathic dilated cardiomyopathy, of which familial dilated cardiomyopathy accounts for 20–25%, is responsible for more than 10,000 deaths in the United States annually and is the predominant indication for cardiac transplantation.

Cardiac arrhythmias can be divided into bradyarrhythmias (slowed rhythms) or tachyarrhythmias (speeded rhythms). Bradyarrhythmias result from abnormalities of intrinsic automatic behavior or conduction, primarily within the atrioventricular node and the His-Purkinje's network. Tachyarrhythmias are caused by altered automaticity, reentry, or triggered automaticity.

Bradyarrhythmias arising from suspected polygenic disorders include Long QT syndrome 4, atrioventricular block, familial sinus node disease, progressive cardiac conduction defect, and familial cardiomyopathy. Tachyarrhythmias with possible underlying polygenic causes include familial ventricular tachycardia, Wolff-Parkinson-White syndrome, familial arrhythmogenic right ventricular dysplasia, heart-hand syndrome V, Mal de Meleda, familial ventricular fibrillation, and familial noncompaction of left ventricular myocardium.

For some of the arrhythmias, one or more of the causative genes have been identified.

For example, atrioventricular block has been associated with mutations in the SCN5A gene, as well as mutations in a locus mapped to 19q13. Studies have shown linkage of familial sinus node disease to a marker on 10q22-q24. Familial ventricular tachycardia has been linked to mutations in genes encoding the G protein subunit alpha-i2 (GNAI1), and/or related genes. Examination of families with Wolff-Parkinson-White syndrome suggest an autosomal dominant pattern of inheritance and evidence of linkage of the disorder to DNA markers on band 7q3. Linkage analysis shows strong evidence for localization of a gene for Mal de Meleda disease on 8qter. Familial ventricular fibrillation can be caused by mutations in the cardiac sodium channel gene SCN5A. Familial noncompaction of left ventricular myocardium has been linked to mutations in the gene encoding tafazzin (TAZ), or in the FK506-binding protein 1A gene (FKBP1A).

Familial dilated cardiomyopathy is characterized by an autosomal dominant pattern of inheritance with age-related penetrance. The linkage of familial dilated cardiomyopathy to several loci indicate that it is polygenic. These loci include CMD1A on 1p11-q11, CMD1B on 9q13, CMD1C on 10q21, CMD1D on 1q32, CMD1E on 3p, CMD1F on 6q, CMD1G on 2q31, CMD1H on 2q14-q22, and CMDLI, which results from mutation in the DES gene on 2q35. In addition, cardiomyopathy can also be caused by mutations in the ACTC gene, the cardiac beta-myosin heavy chain gene (MYH7), or the cardiac troponin T gene.

Familial arrhythmogenic right ventricular dysplasia is inherited as an autosomal dominant with reduced penetrance and is one of the major genetic causes of juvenile sudden death. It is estimated that the prevalence of familial arrhythmogenic right ventricular dysplasia ranges from 6 per 10,000 in the general population to 4.4 per 1,000 in some areas. Several loci for familial arrhythmogenic right ventricular dysplasia have been mapped indicating that this disease is also polygenic in nature. These loci include ARVD1 on 14q23-q24, ARVD2 on 1q42-q43, ARVD3 on 14q12-q22, ARVD4 on 2q32.1-q32.3, ARVD5 on 3p23, and ARVD6 on 10p14-p12.

Progressive cardiac conduction defect (PCCD), also called Lenegre-Lev disease, is one of the most common cardiac conduction diseases. It is characterized by progressive alteration of cardiac conduction through the His-Purkinje system with right or left bundle branch block and widening of QRS complexes, leading to complete atrioventricular block and ultimately causing syncope and sudden death. It represents the major cause of pacemaker implantation in the world (0.15 implantations per 1,000 inhabitants per year in developed countries). The cause of PCCD is unknown but familial cases with right bundle branch block have been reported suggesting that at least some cases are of genetic origin. Reports have linked PCCD to HB1 on 19q13.3, and to mutations in the SCN5A gene (Schott et al., Nature Genet. 23: 20–21 (1999)).

As yet a further example, congenital heart disease occurs at a rate of 8 per 1000 live births, which corresponds to approximately 32,000 infants with newly diagnosed congenital heart disease each year in the United States. Twenty percent of infants with congenital heart disease die within the first year of life. Approximately 80% of the first-year survivors live to reach adulthood. Congenital heart disease also has economic impact due to the estimated 20,000 surgical procedures performed to correct circulatory defects in these patients. The estimated number of adults with congenital heart disease in the United States is currently about 900,000.

In 90% of patients, congenital heart disease is attributable to multifactorial inheritance. Only 5–10% of malformations are due to primary genetic factors, which are either chromosomal or a result of a single mutant gene.

The most common congenital heart disease found in adults is bicuspid aortic valve. This defect occurs in 2% of the general population and accounts for approximately 50% of operated cases of aortic stenosis in adults. Atrial septal defect is responsible for 30–40% of congenital heart disease seen in adults. The most common congenital cardiac defect observed in the pediatric population is ventricular septal defect, which accounts for 15–20% of all congenital lesions. Tetralogy of Fallot is the most common cyanotic congenital anomaly observed in adults. Other congenital heart diseases include Eisenmenger's syndrome, patent ductus arteriosus, pulmonary stenosis, coarctation of the aorta, transposition of the great arteries, tricuspid atresia, univentricular heart, Ebstein's anomaly, and double-outlet right ventricle.

A number of studies have identified putative genetic loci associated with one or more congenital heart diseases.

Congenital heart disease affects more than 40% of all Down syndrome patients. The candidate chromosomal region containing the putative gene or genes for congenital heart disease associated with Down syndrome is 21q22.2-q22.3, between ETS2 and MX1.

DiGeorge syndrome (DGS) is characterized by several symptoms including outflow tract defects of the heart such as teratology of Fallot. Most cases result from a deletion of chromosome 22q11.2 (the DiGeorge syndrome chromosome region, or DGCR). The 22q11 deletion is the second most common cause of congenital heart disease after Down syndrome. Several genes are lost in this deletion including the putative transcription factor TUPLE1. This deletion is associated with a variety of phenotypes, e.g., Shprintzen syndrome; conotruncal anomaly face (or Takao syndrome); and isolated outflow tract defects of the heart including Tetralogy of Fallot, truncus arteriosus, and interrupted aortic arch.

Whereas 90% of cases of DGS may now be attributed to a 22q11 deletion, other associated chromosome defects have been identified. For example, Greenberg et al., Am. J. Hum. Genet. 43:605–611 (1988), reported 1 case of DGS with del10p13 and one with a 18q21.33 deletion. Fukushima et al., Am. J. Hum. Genet. 51 (suppl.):A80 (1992) reported linkage with a deletion of 4q21.3-q25. Gottlieb et al., Am. J. Hum. Genet. 62: 495–498 (1998) concluded that the deletion of more than 1 region on 10p could be associated with the DGS phenotype. The association of the DiGeorge syndrome with at least 2 and possibly more chromosomal locations suggests strongly the involvement of several genes in this disease.

Digilio et al., J. Med. Genet. 34: 188–190 (1997), calculated empiric risk figures for recurrence of isolated Tetralogy of Fallot in families after exclusion of del(22q11), and concluded that gene(s) different from those located on 22q11 must be involved in causing familial aggregation of non-syndromic Tetralogy of Fallot. Johnson et al., Am. J. Med. Genet. (1997) conducted a cytogenetic evaluation of 159 cases of Tetralogy of Fallot. They reported that a del(22q11) was identified in 14% who underwent fluorescence in situ hybridization (FISH) testing with the N25 cosmid probe.

Other congenital heart disease are also suspected to be of polygenic origin. For example, Holmes et al., Birth Defects Orig. Art. Ser. X(4): 228–230 (1974) described familial clustering of hypoplastic left heart syndrome in siblings consistent with multifactorial causation.

Other significant diseases of the heart and vascular system are also believed to have a genetic, typically polygenic, etiological component. These diseases include, for example, hypoplastic left heart syndrome, cardiac valvular dysplasia, Pfeiffer cardiocranial syndrome, oculofaciocardiodental syndrome, Kapur-Toriello syndrome, Sonoda syndrome, Ohdo Blepharophimosis syndrome, heart-hand syndrome, Pierre-Robin syndrome, Hirschsprung disease, Kousseff syndrome, Grange occlusive arterial syndrome, Kearns-Sayre syndrome, Kartagener syndrome, Alagille syndrome, Ritscher-Schinzel syndrome, Ivemark syndrome, Young-Simpson syndrome, hemochromatosis, Holzgreve syndrome, Barth syndrome, Smith-Lemli-Opitz syndrome, glycogen storage disease, Gaucher-like disease, Fabry disease, Lowry-Maclean syndrome, Rett syndrome, Opitz syndrome, Marfan syndrome, Miller-Dieker lissencephaly syndrome, mucopolysaccharidosis, Bruada syndrome, humerospinal dysostosis, Phaver syndrome, McDonough syndrome, Marfanoid hypermobility syndrome, atransferrinemia, Cornelia de Lange syndrome, Leopard syndrome, Diamond-Blackfan anemia, Steinfeld syndrome, progeria, and Williams-Beuren syndrome.

hGDMLP-1 defects will be found to contribute to at least some of the aforementioned disorders.

All patents, patent publications, and other published references mentioned herein are hereby incorporated by reference in their entireties as if each had been individually and specifically incorporated by reference herein. By their citation of various references in this document, applicants do not admit that any particular reference is "prior art" to their invention.

While specific examples have been provided, the above description is illustrative and not restrictive. Any one or more of the features of the previously described embodiments can be combined in any manner with one or more features of any other embodiments in the present invention. Furthermore, many variations of the invention will become apparent to those skilled in the art upon review of the specification. The scope of the invention should, therefore, be determined by reference to the appended claims, along with their full scope of equivalents.

SEQUENCE LISTING (15755 sequences)

SEQ ID NO: 1 - DNA, 8117 bp, Homo sapiens
cacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttgcattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggccggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctgggcatctcagagagcgagcagcgggctgtttggcgggtcctggcagccatctaccacctgggcgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcagcaggtccgcttaccagctggaggaggtgcccaggatgccagaggccttttctgggtcttagatgaggaagtccatgtagagggctccagtgacagtgtggtgctcgagcgtctgtgtgctactttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaacagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaagggatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcaaaaaaaaaaaaaaaaaaaaaaaaaaaa

SEQ ID NO: 2 - DNA, 7707 bp, Homo sapiens
atggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttgcattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggccggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctgggcatctcagagagcgagcagcgggctgtttggcgggtcctggcagccatctaccacctgggcgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaacagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggaaggtgttcctgtgcagtttgacctcccggacccctccccagggaccaccgtggctgttgtggatcaaaatccctctcagcaggtccgcttaccagctggaggaggtgcccaggatgccagaggccttttctgggtcttagatgaggaagtccatgtagagggctccagtgacagtgtggtgctcgagcgtctgtgtgctactttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaacagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaagggatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtag

SEQ ID NO: 3 - protein, 2568 aa, Homo sapiens [sequence omitted]

SEQ ID NO: 4 - DNA, 2953 bp, Homo sapiens
cacccggggagacgtcttagacagtcgtggttcctgtgatctgtgtcctctttgcagaagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagagatcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccaggctcctgaggacagatggtatgaggcagagaaagtctggctggctcagaaggatggatttactcttgctacggtgctaaagccagatgagggaacagcagacctgccagcaggaagggtgagactttgcattgatgctgacaaaaccatcactgaggtggatgaggagcatgtccatcgggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgcccaagggccgccgggatggcctgcctgcccacattggctccatggcacagcgggcatactgggcgctgctgaaccagcggagagaccagagcattgtggccctgggccggagtggcgctgggaagaccacctgctgtgagcaggtcctggaacacctggtggggatggcaggcagtgtggatggcagggtctcagtggagaagatccgagccaccttcactgtcctccgggccttcggctctgtgtccatggcccacagccgcagtgccacccggttctccatggtgatgtcgctggacttcaacgctacaggccgcatcacagctgctcagctccagacaatgcttttggagaagagccgcgtggcacggcagccggaaggggaaagtaacttcctggttttctcccagatgctggctggattggacttggatctcaggacggagctgaacctgcaccagatggcagatagcagctcctttggcatgggcgtgtggtccaagcctgaagataaacagaaggcggcagctgcctttgcccagctccagggtgccatggagatgctgggcatctcagagagcgagcagcgggctgtttggcgggtcctggcagccatctaccacctgggcgcggcgggggcctgcaaagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcagggctcaagatgacaggagtggactgtgtggaggggatggcctcgggcctgtaccaggaactctttgcggctgtggtctcactcatcaac

SEQ ID NO: 5 - DNA, 4916 bp, Homo sapiens
cccggacccctccccagggaccaccgtggctgttgtggatcaaaatccctctcagcaggtccgcttaccagctggaggaggtgcccaggatgccagaggccttttctgggtcttagatgaggaagtccatgtagagggctccagtgacagtgtggtgctcgagcgtctgtgtgctactttcgagaagaaaggagctgggactgaagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaacagtcaaaaagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggctatgctgaccacatggggctcactcgcttccgccggcaattccaggtgctggacgctccactcctgaagaagctcatgtcgacctccgagggaatagatgaaaggaaggccgtggaggagctcctggagaccctggatctggaaaagaaggcggtggctgtggggcacagccaagtttttctcaaggcaggtgtgatctccaggcttgagaagcagcgagagaagctggtatctcagagcatcgttctcttccaggcggcttgcaagggctttctgtctcgccaggaattcaagaagctgaagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggaggagcttacaacgctaagacggaagctagaaaaatcagagaagttgcggaatgaactccggcagaacacagatctgctagaaagcaagattgctgacttgacctctgaccttgccgatgagcgcttcaaaggtgatgtggcctgccaggtgctggagagtgagcgggcagagcggctacaggccttccgggaggtccaggagctcaagagcaagcatgaacaagtccagaaaaaactgggagatgtgaataaacagttggaagaagcccagcagaaaattcagttgaatgacttggaaagggatcccactggaggagcagacgagtggcagatgcgcttcgactgtgctcagatggagaacgagttcctcagaaagcgtctgcagcaatgcgaggagaggctggactcggagctgacagccaggaaagagctggagcaaaagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtttgacctgcagctggcccaggccctaggtgagtcagtgtttgagaagggtctccgtgagaaagtgacccaggagaacaccagtgtccggtgggagctaggccagcttcagcagcagctgaagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcagctccgccagcggtttgagctggagatcgagcggatgaagcagatgcaccagaaggaccgtgaggaccaggaggaggaactggaggatgtccgtcagtcctgccagaagcggcttcatcagctggaaatgcagctggagcaagagtatgaagagaagcagatggtcctccatgagaagcaagatttggaaggcttgatcggaaccctctgtgaccagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccagctggagcagagtgaagccaagtgtgaggaggccttgaagacgcagaaggtgctcacagcggacctggagagcatgcacagcgagctggagaacatgacgcggaacaagagcctggtggatgagcagctgtacaggctgcagtttgagaaggcggacctcctgaagcgcatcgatgaggaccaggatgacctgaatgagctgatgcagaagcacaaggacctcattgctcagtctgctgctgacattgggcagatccaagaactgcagctgcagctggaggaagccaagaaggagaagcacaagctacaagaacaactgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggagaagtacgtggaggaacttgcagcagtgaggcaaaccctccagacagacctggagacatccattcggcggattgccgacctgcaggctgccttggaagaagtggcatccagtgacagtgatactgagagtgtccagacggcagtggattgtggcagcagcggccgaaaagagatggataacgtctccatcctcagctcccagccagagggcagcctgcagtcctggttgagctgtactctgtccctggccacagatactatgaggactccttctcgacagtcagccaccagcagccgcatcctcagccccaggataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggca

SEQ ID NO: 6 - DNA, 17 bp, Homo sapiens
cacccggggagacgtct

SEQ ID NO: 7 - DNA, 17 bp, Homo sapiens
acccggggagacgtctt

SEQ ID NO: 8 - DNA, 17 bp, Homo sapiens
cccggggagacgtctta

SEQ ID NO: 9 - DNA, 17 bp, Homo sapiens
ccggggagacgtcttag

SEQ ID NO: 10 - DNA, 17 bp, Homo sapiens
cggggagacgtcttaga

SEQ ID NO: 11 - DNA, 17 bp, Homo sapiens
ggggagacgtcttagac

SEQ ID NO: 12 - DNA, 17 bp, Homo sapiens
gggagacgtcttagaca

SEQ ID NO: 13 - DNA, 17 bp, Homo sapiens
ggagacgtcttagacag

SEQ ID NO: 14 - DNA, 17 bp, Homo sapiens
gagacgtcttagacagt

SEQ ID NO: 15 - DNA, 17 bp, Homo sapiens
agacgtcttagacagtc

SEQ ID NO: 16 - DNA, 17 bp, Homo sapiens
gacgtcttagacagtcg

SEQ ID NO: 17 - DNA, 17 bp, Homo sapiens
acgtcttagacagtcgt

SEQ ID NO: 18 - DNA, 17 bp, Homo sapiens
cgtcttagacagtcgtg

SEQ ID NO: 19 - DNA, 17 bp, Homo sapiens
gtcttagacagtcgtgg

SEQ ID NO: 20 - DNA, 17 bp, Homo sapiens
tcttagacagtcgtggt

SEQ ID NO: 21 - DNA, 17 bp, Homo sapiens
cttagacagtcgtggtt

SEQ ID NO: 22 - DNA, 17 bp, Homo sapiens
ttagacagtcgtggttc

SEQ ID NO: 23 - DNA, 17 bp, Homo sapiens
tagacagtcgtggttcc

SEQ ID NO: 24 - DNA, 17 bp, Homo sapiens
agacagtcgtggttcct

SEQ ID NO: 25 - DNA, 17 bp, Homo sapiens
gacagtcgtggttcctg

SEQ ID NO: 26 - DNA, 17 bp, Homo sapiens
acagtcgtggttcctgt

SEQ ID NO: 27 - DNA, 17 bp, Homo sapiens
cagtcgtggttcctgtg

SEQ ID NO: 28 - DNA, 17 bp, Homo sapiens
agtcgtggttcctgtga

SEQ ID NO: 29 - DNA, 17 bp, Homo sapiens
gtcgtggttcctgtgat

SEQ ID NO: 30 - DNA, 17 bp, Homo sapiens
tcgtggttcctgtgatc

SEQ ID NO: 31 - DNA, 17 bp, Homo sapiens
cgtggttcctgtgatct

SEQ ID NO: 32 - DNA, 17 bp, Homo sapiens
gtggttcctgtgatctg

SEQ ID NO: 33 - DNA, 17 bp, Homo sapiens
tggttcctgtgatctgt

SEQ ID NO: 34 - DNA, 17 bp, Homo sapiens
ggttcctgtgatctgtg

SEQ ID NO: 35 - DNA, 17 bp, Homo sapiens
gttcctgtgatctgtgt

SEQ ID NO: 36 - DNA, 17 bp, Homo sapiens
ttcctgtgatctgtgtc

SEQ ID NO: 37 - DNA, 17 bp, Homo sapiens
tcctgtgatctgtgtcc

SEQ ID NO: 38 - DNA, 17 bp, Homo sapiens
cctgtgatctgtgtcct

SEQ ID NO: 39 - DNA, 17 bp, Homo sapiens
ctgtgatctgtgtcctc

SEQ ID NO: 40 - DNA, 17 bp, Homo sapiens
tgtgatctgtgtcctct

SEQ ID NO: 41 - DNA, 17 bp, Homo sapiens
gtgatctgtgtcctctt

SEQ ID NO: 42 - DNA, 17 bp, Homo sapiens
tgatctgtgtcctcttt

SEQ ID NO: 43 - DNA, 17 bp, Homo sapiens
gatctgtgtcctctttg

SEQ ID NO: 44 - DNA, 17 bp, Homo sapiens
atctgtgtcctctttgc

SEQ ID NO: 45 - DNA, 17 bp, Homo sapiens
tctgtgtcctctttgca

SEQ ID NO: 46 - DNA, 17 bp, Homo sapiens
ctgtgtcctctttgcag

SEQ ID NO: 47 - DNA, 17 bp, Homo sapiens
tgtgtcctctttgcaga

SEQ ID NO: 48 - DNA, 17 bp, Homo sapiens
gtgtcctctttgcagaa

SEQ ID NO: 49 - DNA, 17 bp, Homo sapiens
tgtcctctttgcagaag

SEQ ID NO: 50 - DNA, 17 bp, Homo sapiens
gtcctctttgcagaagt

SEQ ID NO: 51 - DNA, 17 bp, Homo sapiens
tcctctttgcagaagtt

SEQ ID NO: 52 - DNA, 17 bp, Homo sapiens
cctctttgcagaagttc

SEQ ID NO: 53 - DNA, 17 bp, Homo sapiens
ctctttgcagaagttct

SEQ ID NO: 54 - DNA, 17 bp, Homo sapiens
tctttgcagaagttctg

SEQ ID NO: 55 - DNA, 17 bp, Homo sapiens
ctttgcagaagttctgt

SEQ ID NO: 56 - DNA, 17 bp, Homo sapiens
tttgcagaagttctgtg

SEQ ID NO: 57 - DNA, 17 bp, Homo sapiens
ttgcagaagttctgtgt

SEQ ID NO: 58 - DNA, 17 bp, Homo sapiens
tgcagaagttctgtgtc

SEQ ID NO: 59 - DNA, 17 bp, Homo sapiens
gcagaagttctgtgtcc

SEQ ID NO: 60 - DNA, 17 bp, Homo sapiens
cagaagttctgtgtcca

SEQ ID NO: 61 - DNA, 17 bp, Homo sapiens
agaagttctgtgtccat

SEQ ID NO: 62 - DNA, 17 bp, Homo sapiens
gaagttctgtgtccatc

SEQ ID NO: 63 - DNA, 17 bp, Homo sapiens
aagttctgtgtccatct

SEQ ID NO: 64 - DNA, 17 bp, Homo sapiens
agttctgtgtccatctc

SEQ ID NO: 65 - DNA, 17 bp, Homo sapiens
gttctgtgtccatctca

SEQ ID NO: 66 - DNA, 17 bp, Homo sapiens
ttctgtgtccatctcat

SEQ ID NO: 67 - DNA, 17 bp, Homo sapiens
tctgtgtccatctcatg

SEQ ID NO: 68 - DNA, 17 bp, Homo sapiens
ctgtgtccatctcatgt

SEQ ID NO: 69 - DNA, 17 bp, Homo sapiens
tgtgtccatctcatgtg

SEQ ID NO: 70 - DNA, 17 bp, Homo sapiens
gtgtccatctcatgtgc

SEQ ID NO: 71 - DNA, 17 bp, Homo sapiens
tgtccatctcatgtgct

SEQ ID NO: 72 - DNA, 17 bp, Homo sapiens
gtccatctcatgtgctg

SEQ ID NO: 73 - DNA, 17 bp, Homo sapiens
tccatctcatgtgctgc

SEQ ID NO: 74 - DNA, 17 bp, Homo sapiens
ccatctcatgtgctgcg

SEQ ID NO: 75 - DNA, 17 bp, Homo sapiens
catctcatgtgctgcgt

SEQ ID NO: 76 - DNA, 17 bp, Homo sapiens
atctcatgtgctgcgtg

SEQ ID NO: 77 - DNA, 17 bp, Homo sapiens
tctcatgtgctgcgtgt

SEQ ID NO: 78 - DNA, 17 bp, Homo sapiens
ctcatgtgctgcgtgtg

SEQ ID NO: 79 - DNA, 17 bp, Homo sapiens
tcatgtgctgcgtgtgt

SEQ ID NO: 80 - DNA, 17 bp, Homo sapiens
catgtgctgcgtgtgtc

SEQ ID NO: 81 - DNA, 17 bp, Homo sapiens
atgtgctgcgtgtgtct

SEQ ID NO: 82 - DNA, 17 bp, Homo sapiens
tgtgctgcgtgtgtctg

SEQ ID NO: 83 - DNA, 17 bp, Homo sapiens
gtgctgcgtgtgtctgt

SEQ ID NO: 84 - DNA, 17 bp, Homo sapiens
tgctgcgtgtgtctgta

SEQ ID NO: 85 - DNA, 17 bp, Homo sapiens
gctgcgtgtgtctgtaa

SEQ ID NO: 86 - DNA, 17 bp, Homo sapiens
ctgcgtgtgtctgtaaa

SEQ ID NO: 87 - DNA, 17 bp, Homo sapiens
tgcgtgtgtctgtaaag

SEQ ID NO: 88 - DNA, 17 bp, Homo sapiens
gcgtgtgtctgtaaagc

SEQ ID NO: 89 - DNA, 17 bp, Homo sapiens
cgtgtgtctgtaaagcc

SEQ ID NO: 90 - DNA, 17 bp, Homo sapiens
gtgtgtctgtaaagcct

SEQ ID NO: 91 - DNA, 17 bp, Homo sapiens
tgtgtctgtaaagcctc

SEQ ID NO: 92 - DNA, 17 bp, Homo sapiens
gtgtctgtaaagcctca

SEQ ID NO: 93 - DNA, 17 bp, Homo sapiens
tgtctgtaaagcctcat

SEQ ID NO: 94 - DNA, 17 bp, Homo sapiens
gtctgtaaagcctcatt

SEQ ID NO: 95 - DNA, 17 bp, Homo sapiens
tctgtaaagcctcattc

SEQ ID NO: 96 - DNA, 17 bp, Homo sapiens
ctgtaaagcctcattcc

SEQ ID NO: 97 - DNA, 17 bp, Homo sapiens
tgtaaagcctcattccg

SEQ ID NO: 98 - DNA, 17 bp, Homo sapiens
gtaaagcctcattccgt

SEQ ID NO: 99 - DNA, 17 bp, Homo sapiens
taaagcctcattccgtg

SEQ ID NO: 100 - DNA, 17 bp, Homo sapiens
aaagcctcattccgtgc

SEQ ID NO: 101 - DNA, 17 bp, Homo sapiens
aagcctcattccgtgct

SEQ ID NO: 102 - DNA, 17 bp, Homo sapiens
agcctcattccgtgctg

SEQ ID NO: 103 - DNA, 17 bp, Homo sapiens
gcctcattccgtgctgt

SEQ ID NO: 104 - DNA, 17 bp, Homo sapiens
cctcattccgtgctgtc

SEQ ID NO: 105 - DNA, 17 bp, Homo sapiens
ctcattccgtgctgtct

SEQ ID NO: 106 - DNA, 17 bp, Homo sapiens
tcattccgtgctgtctg

SEQ ID NO: 107 - DNA, 17 bp, Homo sapiens
cattccgtgctgtctgg

SEQ ID NO: 108 - DNA, 17 bp, Homo sapiens
attccgtgctgtctggc

SEQ ID NO: 109 - DNA, 17 bp, Homo sapiens
ttccgtgctgtctggca

SEQ ID NO: 110 - DNA, 17 bp, Homo sapiens
tccgtgctgtctggcag

SEQ ID NO: 111 - DNA, 17 bp, Homo sapiens
ccgtgctgtctggcagg

SEQ ID NO: 112 - DNA, 17 bp, Homo sapiens
cgtgctgtctggcagga

SEQ ID NO: 113 - DNA, 17 bp, Homo sapiens
gtgctgtctggcaggaa

SEQ ID NO: 114 - DNA, 17 bp, Homo sapiens
tgctgtctggcaggaag

SEQ ID NO: 115 - DNA, 17 bp, Homo sapiens
gctgtctggcaggaagc

SEQ ID NO: 116 - DNA, 17 bp, Homo sapiens
ctgtctggcaggaagct

SEQ ID NO: 117 - DNA, 17 bp, Homo sapiens
tgtctggcaggaagctc

SEQ ID NO: 118 - DNA, 17 bp, Homo sapiens
gtctggcaggaagctcc

SEQ ID NO: 119 - DNA, 17 bp, Homo sapiens
tctggcaggaagctcca

SEQ ID NO: 120 - DNA, 17 bp, Homo sapiens
ctggcaggaagctccat

SEQ ID NO: 121 - DNA, 17 bp, Homo sapiens
tggcaggaagctccatc

SEQ ID NO: 122 - DNA, 17 bp, Homo sapiens
ggcaggaagctccatct

SEQ ID NO: 123 - DNA, 17 bp, Homo sapiens
gcaggaagctccatctc

SEQ ID NO: 124 - DNA, 17 bp, Homo sapiens
caggaagctccatctca

SEQ ID NO: 125 - DNA, 17 bp, Homo sapiens
aggaagctccatctcat

SEQ ID NO: 126 - DNA, 17 bp, Homo sapiens
ggaagctccatctcatc

SEQ ID NO: 127 - DNA, 17 bp, Homo sapiens
gaagctccatctcatct

SEQ ID NO: 128 - DNA, 17 bp, Homo sapiens
aagctccatctcatctc

SEQ ID NO: 129 - DNA, 17 bp, Homo sapiens
agctccatctcatctca

SEQ ID NO: 130 - DNA, 17 bp, Homo sapiens
gctccatctcatctcat

SEQ ID NO: 131 - DNA, 17 bp, Homo sapiens
ctccatctcatctcatc

SEQ ID NO: 132 - DNA, 17 bp, Homo sapiens
tccatctcatctcatca

SEQ ID NO: 133 - DNA, 17 bp, Homo sapiens
ccatctcatctcatcat

SEQ ID NO: 134 - DNA, 17 bp, Homo sapiens
catctcatctcatcatc

SEQ ID NO: 135 - DNA, 17 bp, Homo sapiens
atctcatctcatcatct

SEQ ID NO: 136 - DNA, 17 bp, Homo sapiens
tctcatctcatcatctc

SEQ ID NO: 137 - DNA, 17 bp, Homo sapiens
ctcatctcatcatctca

SEQ ID NO: 138 - DNA, 17 bp, Homo sapiens
tcatctcatcatctcac

SEQ ID NO: 139 - DNA, 17 bp, Homo sapiens
catctcatcatctcacg

SEQ ID NO: 140 - DNA, 17 bp, Homo sapiens
atctcatcatctcacgg

SEQ ID NO: 141 - DNA, 17 bp, Homo sapiens
tctcatcatctcacggc

SEQ ID NO: 142 - DNA, 17 bp, Homo sapiens
ctcatcatctcacggcc

SEQ ID NO: 143 - DNA, 17 bp, Homo sapiens
tcatcatctcacggccc

SEQ ID NO: 144 - DNA, 17 bp, Homo sapiens
catcatctcacggccct

SEQ ID NO: 145 - DNA, 17 bp, Homo sapiens
atcatctcacggccctg

SEQ ID NO: 146 - DNA, 17 bp, Homo sapiens
tcatctcacggccctgg

SEQ ID NO: 147 - DNA, 17 bp, Homo sapiens
catctcacggccctggc

SEQ ID NO: 148 - DNA, 17 bp, Homo sapiens
atctcacggccctggca

SEQ ID NO: 149 - DNA, 17 bp, Homo sapiens
tctcacggccctggcac

SEQ ID NO: 150 - DNA, 17 bp, Homo sapiens
ctcacggccctggcact

SEQ ID NO: 151 - DNA, 17 bp, Homo sapiens
tcacggccctggcactg

SEQ ID NO: 152 - DNA, 17 bp, Homo sapiens
cacggccctggcactgc

SEQ ID NO: 153 - DNA, 17 bp, Homo sapiens
acggccctggcactgcc

SEQ ID NO: 154 - DNA, 17 bp, Homo sapiens
cggccctggcactgcct

SEQ ID NO: 155 - DNA, 17 bp, Homo sapiens
ggccctggcactgcctc

SEQ ID NO: 156 - DNA, 17 bp, Homo sapiens
gccctggcactgcctca

SEQ ID NO: 157 - DNA, 17 bp, Homo sapiens
ccctggcactgcctcag

SEQ ID NO: 158 - DNA, 17 bp, Homo sapiens
cctggcactgcctcagc

SEQ ID NO: 159 - DNA, 17 bp, Homo sapiens
ctggcactgcctcagca

SEQ ID NO: 160 - DNA, 17 bp, Homo sapiens
tggcactgcctcagcat

SEQ ID NO: 161 - DNA, 17 bp, Homo sapiens
ggcactgcctcagcatg

SEQ ID NO: 162 - DNA, 17 bp, Homo sapiens
gcactgcctcagcatgg

SEQ ID NO: 163 - DNA, 17 bp, Homo sapiens
cactgcctcagcatggc

SEQ ID NO: 164 - DNA, 17 bp, Homo sapiens
actgcctcagcatggcc

SEQ ID NO: 165 - DNA, 17 bp, Homo sapiens
ctgcctcagcatggcca

SEQ ID NO: 166 - DNA, 17 bp, Homo sapiens
tgcctcagcatggccat

SEQ ID NO: 167 - DNA, 17 bp, Homo sapiens
gcctcagcatggccatc

SEQ ID NO: 168 - DNA, 17 bp, Homo sapiens
cctcagcatggccatct

SEQ ID NO: 169 - DNA, 17 bp, Homo sapiens
ctcagcatggccatctc

SEQ ID NO: 170 - DNA, 17 bp, Homo sapiens
tcagcatggccatctca

SEQ ID NO: 171 - DNA, 17 bp, Homo sapiens
cagcatggccatctcat

SEQ ID NO: 172 - DNA, 17 bp, Homo sapiens
agcatggccatctcatc

SEQ ID NO: 173 - DNA, 17 bp, Homo sapiens
gcatggccatctcatca

SEQ ID NO: 174 - DNA, 17 bp, Homo sapiens
catggccatctcatcac

SEQ ID NO: 175 - DNA, 17 bp, Homo sapiens
atggccatctcatcacg

SEQ ID NO: 176 - DNA, 17 bp, Homo sapiens
tggccatctcatcacgc

SEQ ID NO: 177 - DNA, 17 bp, Homo sapiens
ggccatctcatcacgcc

SEQ ID NO: 178 - DNA, 17 bp, Homo sapiens
gccatctcatcacgcct

SEQ ID NO: 179 - DNA, 17 bp, Homo sapiens
ccatctcatcacgcctc

SEQ ID NO: 180 - DNA, 17 bp, Homo sapiens
catctcatcacgcctcg

SEQ ID NO: 181 - DNA, 17 bp, Homo sapiens
atctcatcacgcctcgc

SEQ ID NO: 182 - DNA, 17 bp, Homo sapiens
tctcatcacgcctcgcc

SEQ ID NO: 183 - DNA, 17 bp, Homo sapiens
ctcatcacgcctcgccc

SEQ ID NO: 184 - DNA, 17 bp, Homo sapiens
tcatcacgcctcgccct

SEQ ID NO: 185 - DNA, 17 bp, Homo sapiens
catcacgcctcgccctg

SEQ ID NO: 186 - DNA, 17 bp, Homo sapiens
atcacgcctcgccctgt

SEQ ID NO: 187 - DNA, 17 bp, Homo sapiens
tcacgcctcgccctgtg

SEQ ID NO: 188 - DNA, 17 bp, Homo sapiens
cacgcctcgccctgtgg

SEQ ID NO: 189 - DNA, 17 bp, Homo sapiens
acgcctcgccctgtggg

SEQ ID NO: 190 - DNA, 17 bp, Homo sapiens
cgcctcgccctgtggga

SEQ ID NO: 191 - DNA, 17 bp, Homo sapiens
gcctcgccctgtgggag

SEQ ID NO: 192 - DNA, 17 bp, Homo sapiens
cctcgccctgtgggagc

SEQ ID NO: 193 - DNA, 17 bp, Homo sapiens
ctcgccctgtgggagca

SEQ ID NO: 194 - DNA, 17 bp, Homo sapiens
tcgccctgtgggagcag

SEQ ID NO: 195 - DNA, 17 bp, Homo sapiens
cgccctgtgggagcaga

SEQ ID NO: 196 - DNA, 17 bp, Homo sapiens
gccctgtgggagcagaa

SEQ ID NO: 197 - DNA, 17 bp, Homo sapiens
ccctgtgggagcagaag

SEQ ID NO: 198 - DNA, 17 bp, Homo sapiens
cctgtgggagcagaaga

SEQ ID NO: 199 - DNA, 17 bp, Homo sapiens
ctgtgggagcagaagat

SEQ ID NO: 200 - DNA, 17 bp, Homo sapiens
tgtgggagcagaagatt

SEQ ID NO: 201 - DNA, 17 bp, Homo sapiens
gtgggagcagaagattc

SEQ ID NO: 202 - DNA, 17 bp, Homo sapiens
tgggagcagaagattcg

SEQ ID NO: 203 - DNA, 17 bp, Homo sapiens
gggagcagaagattcgg

SEQ ID NO: 204 - DNA, 17 bp, Homo sapiens
ggagcagaagattcggg

SEQ ID NO: 205 - DNA, 17 bp, Homo sapiens
gagcagaagattcggga

SEQ ID NO: 206 - DNA, 17 bp, Homo sapiens
agcagaagattcgggaa

SEQ ID NO: 207 - DNA, 17 bp, Homo sapiens
gcagaagattcgggaag

SEQ ID NO: 208 - DNA, 17 bp, Homo sapiens
cagaagattcgggaaga

SEQ ID NO: 209 - DNA, 17 bp, Homo sapiens
agaagattcgggaagag

SEQ ID NO: 210 - DNA, 17 bp, Homo sapiens
gaagattcgggaagagg

SEQ ID NO: 211 - DNA, 17 bp, Homo sapiens
aagattcgggaagagga

SEQ ID NO: 212 - DNA, 17 bp, Homo sapiens
agattcgggaagaggac

SEQ ID NO: 213 - DNA, 17 bp, Homo sapiens
gattcgggaagaggaca

SEQ ID NO: 214 - DNA, 17 bp, Homo sapiens
attcgggaagaggacaa

SEQ ID NO: 215 - DNA, 17 bp, Homo sapiens
ttcgggaagaggacaag

SEQ ID NO: 216 - DNA, 17 bp, Homo sapiens
tcgggaagaggacaaga

SEQ ID NO: 217 - DNA, 17 bp, Homo sapiens
cgggaagaggacaagag

SEQ ID NO: 218 - DNA, 17 bp, Homo sapiens
gggaagaggacaagagc

SEQ ID NO: 219 - DNA, 17 bp, Homo sapiens
ggaagaggacaagagcc

SEQ ID NO: 220 - DNA, 17 bp, Homo sapiens
gaagaggacaagagccc

SEQ ID NO: 221 - DNA, 17 bp, Homo sapiens
aagaggacaagagccct

SEQ ID NO: 222 - DNA, 17 bp, Homo sapiens
agaggacaagagccctc

SEQ ID NO: 223 - DNA, 17 bp, Homo sapiens
gaggacaagagccctcc

SEQ ID NO: 224 - DNA, 17 bp, Homo sapiens
aggacaagagccctcca

SEQ ID NO: 225 - DNA, 17 bp, Homo sapiens
ggacaagagccctccac

SEQ ID NO: 226 - DNA, 17 bp, Homo sapiens
gacaagagccctccacc

SEQ ID NO: 227 - DNA, 17 bp, Homo sapiens
acaagagccctccacca

SEQ ID NO: 228 - DNA, 17 bp, Homo sapiens
caagagccctccaccat

SEQ ID NO: 229 - DNA, 17 bp, Homo sapiens
aagagccctccaccatc

SEQ ID NO: 230 - DNA, 17 bp, Homo sapiens
agagccctccaccatcc

SEQ ID NO: 231 - DNA, 17 bp, Homo sapiens
gagccctccaccatcct

SEQ ID NO: 232 - DNA, 17 bp, Homo sapiens
agccctccaccatcctc

SEQ ID NO: 233 - DNA, 17 bp, Homo sapiens
gccctccaccatcctcg

SEQ ID NO: 234 - DNA, 17 bp, Homo sapiens
ccctccaccatcctcgc

SEQ ID NO: 235 - DNA, 17 bp, Homo sapiens
cctccaccatcctcgcc

SEQ ID NO: 236 - DNA, 17 bp, Homo sapiens
ctccaccatcctcgccc

SEQ ID NO: 237 - DNA, 17 bp, Homo sapiens
tccaccatcctcgcccc

SEQ ID NO: 238 - DNA, 17 bp, Homo sapiens
ccaccatcctcgccccc

SEQ ID NO: 239 - DNA, 17 bp, Homo sapiens
caccatcctcgccccct

SEQ ID NO: 240 - DNA, 17 bp, Homo sapiens
accatcctcgccccctc

SEQ ID NO: 241 - DNA, 17 bp, Homo sapiens
ccatcctcgccccctcc

SEQ ID NO: 242 - DNA, 17 bp, Homo sapiens
catcctcgccccctcct

SEQ ID NO: 243 - DNA, 17 bp, Homo sapiens
atcctcgccccctcctc

SEQ ID NO: 244 - DNA, 17 bp, Homo sapiens
tcctcgccccctcctct

SEQ ID NO: 245 - DNA, 17 bp, Homo sapiens
cctcgccccctcctctt

SEQ ID NO: 246 - DNA, 17 bp, Homo sapiens
ctcgccccctcctcttt

SEQ ID NO: 247 - DNA, 17 bp, Homo sapiens
tcgccccctcctctttt

SEQ ID NO: 248 - DNA, 17 bp, Homo sapiens
cgccccctcctcttttc

SEQ ID NO: 249 - DNA, 17 bp, Homo sapiens
gccccctcctcttttct

SEQ ID NO: 250 - DNA, 17 bp, Homo sapiens
ccccctcctcttttctc

SEQ ID NO: 251 - DNA, 17 bp, Homo sapiens
cccctcctcttttctct

SEQ ID NO: 252 - DNA, 17 bp, Homo sapiens
ccctcctcttttctctg

SEQ ID NO: 253 - DNA, 17 bp, Homo sapiens
cctcctcttttctctgt

SEQ ID NO: 254 - DNA, 17 bp, Homo sapiens
ctcctcttttctctgtc

SEQ ID NO: 255 - DNA, 17 bp, Homo sapiens
tcctcttttctctgtca

SEQ ID NO: 256 - DNA, 17 bp, Homo sapiens
cctcttttctctgtcat

SEQ ID NO: 257 - DNA, 17 bp, Homo sapiens
ctcttttctctgtcatc

SEQ ID NO: 258 - DNA, 17 bp, Homo sapiens
tcttttctctgtcatcc

SEQ ID NO: 259 - DNA, 17 bp, Homo sapiens
cttttctctgtcatccc

SEQ ID NO: 260 - DNA, 17 bp, Homo sapiens
ttttctctgtcatccca

SEQ ID NO: 261 - DNA, 17 bp, Homo sapiens
tttctctgtcatcccag

SEQ ID NO: 262 - DNA, 17 bp, Homo sapiens
ttctctgtcatcccagg

SEQ ID NO: 263 - DNA, 17 bp, Homo sapiens
tctctgtcatcccaggg

SEQ ID NO: 264 - DNA, 17 bp, Homo sapiens
ctctgtcatcccagggg

SEQ ID NO: 265 - DNA, 17 bp, Homo sapiens
tctgtcatcccaggggg

SEQ ID NO: 266 - DNA, 17 bp, Homo sapiens
ctgtcatcccagggggc

SEQ ID NO: 267 - DNA, 17 bp, Homo sapiens
tgtcatcccagggggct

SEQ ID NO: 268 - DNA, 17 bp, Homo sapiens
gtcatcccagggggctt

SEQ ID NO: 269 - DNA, 17 bp, Homo sapiens
tcatcccagggggcttc

SEQ ID NO: 270 - DNA, 17 bp, Homo sapiens
catcccagggggcttca

SEQ ID NO: 271 - DNA, 17 bp, Homo sapiens
atcccagggggcttcat

SEQ ID NO: 272 - DNA, 17 bp, Homo sapiens
tcccagggggcttcatt

SEQ ID NO: 273 - DNA, 17 bp, Homo sapiens
cccagggggcttcatta

SEQ ID NO: 274 - DNA, 17 bp, Homo sapiens
ccagggggcttcattaa

SEQ ID NO: 275 - DNA, 17 bp, Homo sapiens
cagggggcttcattaag

SEQ ID NO: 276 - DNA, 17 bp, Homo sapiens
agggggcttcattaagc

SEQ ID NO: 277 - DNA, 17 bp, Homo sapiens
gggggcttcattaagca

SEQ ID NO: 278 - DNA, 17 bp, Homo sapiens
ggggcttcattaagcaa

SEQ ID NO: 279 - DNA, 17 bp, Homo sapiens
gggcttcattaagcaac

SEQ ID NO: 280 - DNA, 17 bp, Homo sapiens
ggcttcattaagcaact

SEQ ID NO: 281 - DNA, 17 bp, Homo sapiens
gcttcattaagcaactg

SEQ ID NO: 282 - DNA, 17 bp, Homo sapiens
cttcattaagcaactgg

SEQ ID NO: 283 - DNA, 17 bp, Homo sapiens
ttcattaagcaactggt

SEQ ID NO: 284 - DNA, 17 bp, Homo sapiens
tcattaagcaactggtc

SEQ ID NO: 285 - DNA, 17 bp, Homo sapiens
cattaagcaactggtcc

SEQ ID NO: 286 - DNA, 17 bp, Homo sapiens
attaagcaactggtccg

SEQ ID NO: 287 - DNA, 17 bp, Homo sapiens
ttaagcaactggtccgg

SEQ ID NO: 288 - DNA, 17 bp, Homo sapiens
taagcaactggtccggg

SEQ ID NO: 289 - DNA, 17 bp, Homo sapiens
aagcaactggtccgggg

SEQ ID NO: 290 - DNA, 17 bp, Homo sapiens
agcaactggtccggggg

SEQ ID NO: 291 - DNA, 17 bp, Homo sapiens
gcaactggtccggggga

SEQ ID NO: 292 - DNA, 17 bp, Homo sapiens
caactggtccgggggac

SEQ ID NO: 293 - DNA, 17 bp, Homo sapiens
aactggtccgggggact

SEQ ID NO: 294 - DNA, 17 bp, Homo sapiens
actggtccgggggactg

SEQ ID NO: 295 - DNA, 17 bp, Homo sapiens
ctggtccgggggactga

SEQ ID NO: 296 - DNA, 17 bp, Homo sapiens
tggtccgggggactgaa

SEQ ID NO: 297 - DNA, 17 bp, Homo sapiens
ggtccgggggactgaaa

SEQ ID NO: 298 - DNA, 17 bp, Homo sapiens
gtccgggggactgaaaa

SEQ ID NO: 299 - DNA, 17 bp, Homo sapiens
tccgggggactgaaaaa

SEQ ID NO: 300 - DNA, 17 bp, Homo sapiens
ccgggggactgaaaaag

SEQ ID NO: 301 - DNA, 17 bp, Homo sapiens
cgggggactgaaaaaga

SEQ ID NO: 302 - DNA, 17 bp, Homo sapiens
gggggactgaaaaagag

SEQ ID NO: 303 - DNA, 17 bp, Homo sapiens
ggggactgaaaaagagg

SEQ ID NO: 304 - DNA, 17 bp, Homo sapiens
gggactgaaaaagaggc

SEQ ID NO: 305 - DNA, 17 bp, Homo sapiens
ggactgaaaaagaggcc

SEQ ID NO: 306 - DNA, 17 bp, Homo sapiens
gactgaaaaagaggcca

SEQ ID NO: 307 - DNA, 17 bp, Homo sapiens
actgaaaaagaggccaa

SEQ ID NO: 308 - DNA, 17 bp, Homo sapiens
ctgaaaaagaggccaag

SEQ ID NO: 309 - DNA, 17 bp, Homo sapiens
tgaaaaagaggccaagg

SEQ ID NO: 310 - DNA, 17 bp, Homo sapiens
gaaaaagaggccaagga

SEQ ID NO: 311 - DNA, 17 bp, Homo sapiens
aaaaagaggccaaggaa

SEQ ID NO: 312 - DNA, 17 bp, Homo sapiens
aaaagaggccaaggaag

SEQ ID NO: 313 - DNA, 17 bp, Homo sapiens
aaagaggccaaggaagc

SEQ ID NO: 314 - DNA, 17 bp, Homo sapiens
aagaggccaaggaagcg

SEQ ID NO: 315 - DNA, 17 bp, Homo sapiens
agaggccaaggaagcga

SEQ ID NO: 316 - DNA, 17 bp, Homo sapiens
gaggccaaggaagcgag

SEQ ID NO: 317 - DNA, 17 bp, Homo sapiens
aggccaaggaagcgaga

SEQ ID NO: 318 - DNA, 17 bp, Homo sapiens
ggccaaggaagcgagac

SEQ ID NO: 319 - DNA, 17 bp, Homo sapiens
gccaaggaagcgagaca

SEQ ID NO: 320 - DNA, 17 bp, Homo sapiens
ccaaggaagcgagacag

SEQ ID NO: 321 - DNA, 17 bp, Homo sapiens
caaggaagcgagacaga

SEQ ID NO: 322 - DNA, 17 bp, Homo sapiens
aaggaagcgagacagag

SEQ ID NO: 323 - DNA, 17 bp, Homo sapiens
aggaagcgagacagagg

SEQ ID NO: 324 - DNA, 17 bp, Homo sapiens
ggaagcgagacagagga

SEQ ID NO: 325 - DNA, 17 bp, Homo sapiens
gaagcgagacagaggaa

SEQ ID NO: 326 - DNA, 17 bp, Homo sapiens
aagcgagacagaggaag

SEQ ID NO: 327 - DNA, 17 bp, Homo sapiens
agcgagacagaggaagc

SEQ ID NO: 328 - DNA, 17 bp, Homo sapiens
gcgagacagaggaagca

SEQ ID NO: 329 - DNA, 17 bp, Homo sapiens
cgagacagaggaagcag

SEQ ID NO: 330 - DNA, 17 bp, Homo sapiens
gagacagaggaagcagt

SEQ ID NO: 331 - DNA, 17 bp, Homo sapiens
agacagaggaagcagtt

SEQ ID NO: 332 - DNA, 17 bp, Homo sapiens
gacagaggaagcagtta

SEQ ID NO: 333 - DNA, 17 bp, Homo sapiens
acagaggaagcagttag

SEQ ID NO: 334 - DNA, 17 bp, Homo sapiens
cagaggaagcagttagc

SEQ ID NO: 335 - DNA, 17 bp, Homo sapiens
agaggaagcagttagct

SEQ ID NO: 336 - DNA, 17 bp, Homo sapiens
gaggaagcagttagctg

SEQ ID NO: 337 - DNA, 17 bp, Homo sapiens
aggaagcagttagctgt

SEQ ID NO: 338 - DNA, 17 bp, Homo sapiens
ggaagcagttagctgtc

SEQ ID NO: 339 - DNA, 17 bp, Homo sapiens
gaagcagttagctgtcg

SEQ ID NO: 340 - DNA, 17 bp, Homo sapiens
aagcagttagctgtcgc

SEQ ID NO: 341 - DNA, 17 bp, Homo sapiens
agcagttagctgtcgcc

SEQ ID NO: 342 - DNA, 17 bp, Homo sapiens
gcagttagctgtcgcct

SEQ ID NO: 343 - DNA, 17 bp, Homo sapiens
cagttagctgtcgcctc

SEQ ID NO: 344 - DNA, 17 bp, Homo sapiens
agttagctgtcgcctct

SEQ ID NO: 345 - DNA, 17 bp, Homo sapiens
gttagctgtcgcctctc

SEQ ID NO: 346 - DNA, 17 bp, Homo sapiens
ttagctgtcgcctctcc

SEQ ID NO: 347 - DNA, 17 bp, Homo sapiens
tagctgtcgcctctcca

SEQ ID NO: 348 - DNA, 17 bp, Homo sapiens
agctgtcgcctctccag

SEQ ID NO: 349 - DNA, 17 bp, Homo sapiens
gctgtcgcctctccaga

SEQ ID NO: 350 - DNA, 17 bp, Homo sapiens
ctgtcgcctctccagaa

SEQ ID NO: 351 - DNA, 17 bp, Homo sapiens
tgtcgcctctccagaac

SEQ ID NO: 352 - DNA, 17 bp, Homo sapiens
gtcgcctctccagaacg

SEQ ID NO: 353 - DNA, 17 bp, Homo sapiens
tcgcctctccagaacga

SEQ ID NO: 354 - DNA, 17 bp, Homo sapiens
cgcctctccagaacgag

SEQ ID NO: 355 - DNA, 17 bp, Homo sapiens
gcctctccagaacgaga

SEQ ID NO: 356 - DNA, 17 bp, Homo sapiens
cctctccagaacgagag

SEQ ID NO: 357 - DNA, 17 bp, Homo sapiens
ctctccagaacgagaga

SEQ ID NO: 358 - DNA, 17 bp, Homo sapiens
tctccagaacgagagat

SEQ ID NO: 359 - DNA, 17 bp, Homo sapiens
ctccagaacgagagatc

SEQ ID NO: 360 - DNA, 17 bp, Homo sapiens
tccagaacgagagatcc

SEQ ID NO: 361 - DNA, 17 bp, Homo sapiens
ccagaacgagagatccc

SEQ ID NO: 362 - DNA, 17 bp, Homo sapiens
cagaacgagagatccca

SEQ ID NO: 363 - DNA, 17 bp, Homo sapiens
agaacgagagatcccag

SEQ ID NO: 364 - DNA, 17 bp, Homo sapiens
gaacgagagatcccaga

SEQ ID NO: 365 - DNA, 17 bp, Homo sapiens
aacgagagatcccagaa

SEQ ID NO: 366 - DNA, 17 bp, Homo sapiens
acgagagatcccagaaa

SEQ ID NO: 367 - DNA, 17 bp, Homo sapiens
cgagagatcccagaaat

SEQ ID NO: 368 - DNA, 17 bp, Homo sapiens
gagagatcccagaaatt

SEQ ID NO: 369 - DNA, 17 bp, Homo sapiens
agagatcccagaaattt

SEQ ID NO: 370 - DNA, 17 bp, Homo sapiens
gagatcccagaaatttc

SEQ ID NO: 371 - DNA, 17 bp, Homo sapiens
agatcccagaaatttcc

SEQ ID NO: 372 - DNA, 17 bp, Homo sapiens
gatcccagaaatttcca

SEQ ID NO: 373 - DNA, 17 bp, Homo sapiens
atcccagaaatttccat

SEQ ID NO: 374 - DNA, 17 bp, Homo sapiens
tcccagaaatttccatc

SEQ ID NO: 375 - DNA, 17 bp, Homo sapiens
cccagaaatttccatca

SEQ ID NO: 376 - DNA, 17 bp, Homo sapiens
ccagaaatttccatcag

SEQ ID NO: 377 - DNA, 17 bp, Homo sapiens
cagaaatttccatcagc

SEQ ID NO: 378 - DNA, 17 bp, Homo sapiens
agaaatttccatcagcc

SEQ ID NO: 379 - DNA, 17 bp, Homo sapiens
gaaatttccatcagcca

SEQ ID NO: 380 - DNA, 17 bp, Homo sapiens
aaatttccatcagccaa

SEQ ID NO: 381 - DNA, 17 bp, Homo sapiens
aatttccatcagccaac

SEQ ID NO: 382 - DNA, 17 bp, Homo sapiens
atttccatcagccaacc

SEQ ID NO: 383 - DNA, 17 bp, Homo sapiens
tttccatcagccaaccc

SEQ ID NO: 384 - DNA, 17 bp, Homo sapiens
ttccatcagccaaccca

SEQ ID NO: 385 - DNA, 17 bp, Homo sapiens
tccatcagccaacccaa

SEQ ID NO: 386 - DNA, 17 bp, Homo sapiens
ccatcagccaacccaac

SEQ ID NO: 387 - DNA, 17 bp, Homo sapiens
catcagccaacccaaca

SEQ ID NO: 388 - DNA, 17 bp, Homo sapiens
atcagccaacccaacag

SEQ ID NO: 389 - DNA, 17 bp, Homo sapiens
tcagccaacccaacagc

SEQ ID NO: 390 - DNA, 17 bp, Homo sapiens
cagccaacccaacagca

SEQ ID NO: 391 - DNA, 17 bp, Homo sapiens
agccaacccaacagcaa

SEQ ID NO: 392 - DNA, 17 bp, Homo sapiens
gccaacccaacagcaag

SEQ ID NO: 393 - DNA, 17 bp, Homo sapiens
ccaacccaacagcaagt

SEQ ID NO: 394 - DNA, 17 bp, Homo sapiens
caacccaacagcaagtc

SEQ ID NO: 395 - DNA, 17 bp, Homo sapiens
aacccaacagcaagtcc

SEQ ID NO: 396 - DNA, 17 bp, Homo sapiens
acccaacagcaagtcca

SEQ ID NO: 397 - DNA, 17 bp, Homo sapiens
cccaacagcaagtccag

SEQ ID NO: 398 - DNA, 17 bp, Homo sapiens
ccaacagcaagtccagc

SEQ ID NO: 399 - DNA, 17 bp, Homo sapiens
caacagcaagtccagca

SEQ ID NO: 400 - DNA, 17 bp, Homo sapiens
aacagcaagtccagcag

SEQ ID NO: 401 - DNA, 17 bp, Homo sapiens
acagcaagtccagcagt

SEQ ID NO: 402 - DNA, 17 bp, Homo sapiens
cagcaagtccagcagtg

SEQ ID NO: 403 - DNA, 17 bp, Homo sapiens
agcaagtccagcagtgg

SEQ ID NO: 404 - DNA, 17 bp, Homo sapiens
gcaagtccagcagtggc

SEQ ID NO: 405 - DNA, 17 bp, Homo sapiens
caagtccagcagtggca

SEQ ID NO: 406 - DNA, 17 bp, Homo sapiens
aagtccagcagtggcac

SEQ ID NO: 407 - DNA, 17 bp, Homo sapiens
agtccagcagtggcacc

SEQ ID NO: 408 - DNA, 17 bp, Homo sapiens
gtccagcagtggcacca

SEQ ID NO: 409 - DNA, 17 bp, Homo sapiens
tccagcagtggcaccag

SEQ ID NO: 410 - DNA, 17 bp, Homo sapiens
ccagcagtggcaccaga

SEQ ID NO: 411 - DNA, 17 bp, Homo sapiens
cagcagtggcaccagat

SEQ ID NO: 412 - DNA, 17 bp, Homo sapiens
agcagtggcaccagatc

SEQ ID NO: 413 - DNA, 17 bp, Homo sapiens
gcagtggcaccagatct

SEQ ID NO: 414 - DNA, 17 bp, Homo sapiens
cagtggcaccagatctg

SEQ ID NO: 415 - DNA, 17 bp, Homo sapiens
agtggcaccagatctgg

SEQ ID NO: 416 - DNA, 17 bp, Homo sapiens
gtggcaccagatctgga

SEQ ID NO: 417 - DNA, 17 bp, Homo sapiens
tggcaccagatctggaa

SEQ ID NO: 418 - DNA, 17 bp, Homo sapiens
ggcaccagatctggaag

SEQ ID NO: 419 - DNA, 17 bp, Homo sapiens
gcaccagatctggaagc

SEQ ID NO: 420 - DNA, 17 bp, Homo sapiens
caccagatctggaagcc

SEQ ID NO: 421 - DNA, 17 bp, Homo sapiens
accagatctggaagcca

SEQ ID NO: 422 - DNA, 17 bp, Homo sapiens
ccagatctggaagccag

SEQ ID NO: 423 - DNA, 17 bp, Homo sapiens
cagatctggaagccagc

SEQ ID NO: 424 - DNA, 17 bp, Homo sapiens
agatctggaagccagca

SEQ ID NO: 425 - DNA, 17 bp, Homo sapiens
gatctggaagccagcag

SEQ ID NO: 426 - DNA, 17 bp, Homo sapiens
atctggaagccagcaga

SEQ ID NO: 427 - DNA, 17 bp, Homo sapiens
tctggaagccagcagat

SEQ ID NO: 428 - DNA, 17 bp, Homo sapiens
ctggaagccagcagatc

SEQ ID NO: 429 - DNA, 17 bp, Homo sapiens
tggaagccagcagatct

SEQ ID NO: 430 - DNA, 17 bp, Homo sapiens
ggaagccagcagatctc

SEQ ID NO: 431 - DNA, 17 bp, Homo sapiens
gaagccagcagatctct

SEQ ID NO: 432 - DNA, 17 bp, Homo sapiens
aagccagcagatctctc

SEQ ID NO: 433 - DNA, 17 bp, Homo sapiens
agccagcagatctctca

SEQ ID NO: 434 - DNA, 17 bp, Homo sapiens
gccagcagatctctcag

SEQ ID NO: 435 - DNA, 17 bp, Homo sapiens
ccagcagatctctcagg

SEQ ID NO: 436 - DNA, 17 bp, Homo sapiens
cagcagatctctcagga

SEQ ID NO: 437 - DNA, 17 bp, Homo sapiens
agcagatctctcaggac

SEQ ID NO: 438 - DNA, 17 bp, Homo sapiens
gcagatctctcaggacg

SEQ ID NO: 439 - DNA, 17 bp, Homo sapiens
cagatctctcaggacga

SEQ ID NO: 440 - DNA, 17 bp, Homo sapiens
agatctctcaggacgac

SEQ ID NO: 441 - DNA, 17 bp, Homo sapiens
gatctctcaggacgacc

SEQ ID NO: 442 - DNA, 17 bp, Homo sapiens
atctctcaggacgacca

SEQ ID NO: 443 - DNA, 17 bp, Homo sapiens
tctctcaggacgaccag

SEQ ID NO: 444 - DNA, 17 bp, Homo sapiens
ctctcaggacgaccagt

SEQ ID NO: 445 - DNA, 17 bp, Homo sapiens
tctcaggacgaccagtc

SEQ ID NO: 446 - DNA, 17 bp, Homo sapiens
ctcaggacgaccagtca

SEQ ID NO: 447 - DNA, 17 bp, Homo sapiens
tcaggacgaccagtcaa

SEQ ID NO: 448 - DNA, 17 bp, Homo sapiens
caggacgaccagtcaag

SEQ ID NO: 449 - DNA, 17 bp, Homo sapiens
aggacgaccagtcaagc

SEQ ID NO: 450 - DNA, 17 bp, Homo sapiens
ggacgaccagtcaagct

SEQ ID NO: 451 - DNA, 17 bp, Homo sapiens
gacgaccagtcaagctc

SEQ ID NO: 452 - DNA, 17 bp, Homo sapiens
acgaccagtcaagctct

SEQ ID NO: 453 - DNA, 17 bp, Homo sapiens
cgaccagtcaagctctc

SEQ ID NO: 454 - DNA, 17 bp, Homo sapiens
gaccagtcaagctctcc

SEQ ID NO: 455 - DNA, 17 bp, Homo sapiens
accagtcaagctctcct

SEQ ID NO: 456 - DNA, 17 bp, Homo sapiens
ccagtcaagctctcctg

SEQ ID NO: 457 - DNA, 17 bp, Homo sapiens
cagtcaagctctcctgg

SEQ ID NO: 458 - DNA, 17 bp, Homo sapiens
agtcaagctctcctggg

SEQ ID NO: 459 - DNA, 17 bp, Homo sapiens
gtcaagctctcctggga

SEQ ID NO: 460 - DNA, 17 bp, Homo sapiens
tcaagctctcctgggag

SEQ ID NO: 461 - DNA, 17 bp, Homo sapiens
caagctctcctgggagc

SEQ ID NO: 462 - DNA, 17 bp, Homo sapiens
aagctctcctgggagct

SEQ ID NO: 463 - DNA, 17 bp, Homo sapiens
agctctcctgggagctc

SEQ ID NO: 464 - DNA, 17 bp, Homo sapiens
gctctcctgggagctca

SEQ ID NO: 465 - DNA, 17 bp, Homo sapiens
ctctcctgggagctcag

SEQ ID NO: 466 - DNA, 17 bp, Homo sapiens
tctcctgggagctcaga

SEQ ID NO: 467 - DNA, 17 bp, Homo sapiens
ctcctgggagctcagac

SEQ ID NO: 468 - DNA, 17 bp, Homo sapiens
tcctgggagctcagaca

SEQ ID NO: 469 - DNA, 17 bp, Homo sapiens
cctgggagctcagacat

SEQ ID NO: 470 - DNA, 17 bp, Homo sapiens
ctgggagctcagacatt

SEQ ID NO: 471 - DNA, 17 bp, Homo sapiens
tgggagctcagacattc

SEQ ID NO: 472 - DNA, 17 bp, Homo sapiens
gggagctcagacattct

SEQ ID NO: 473 - DNA, 17 bp, Homo sapiens
ggagctcagacattctg

SEQ ID NO: 474 - DNA, 17 bp, Homo sapiens
gagctcagacattctgg

SEQ ID NO: 475 - DNA, 17 bp, Homo sapiens
agctcagacattctggg

SEQ ID NO: 476 - DNA, 17 bp, Homo sapiens
gctcagacattctgggc

SEQ ID NO: 477 - DNA, 17 bp, Homo sapiens
ctcagacattctgggca

SEQ ID NO: 478 - DNA, 17 bp, Homo sapiens
tcagacattctgggcaa

SEQ ID NO: 479 - DNA, 17 bp, Homo sapiens
cagacattctgggcaag

SEQ ID NO: 480 - DNA, 17 bp, Homo sapiens
agacattctgggcaagg

SEQ ID NO: 481 - DNA, 17 bp, Homo sapiens
gacattctgggcaagga

SEQ ID NO: 482 - DNA, 17 bp, Homo sapiens
acattctgggcaaggag

SEQ ID NO: 483 - DNA, 17 bp, Homo sapiens
cattctgggcaaggaga

SEQ ID NO: 484 - DNA, 17 bp, Homo sapiens
attctgggcaaggagag

SEQ ID NO: 485 - DNA, 17 bp, Homo sapiens
ttctgggcaaggagagc

SEQ ID NO: 486 - DNA, 17 bp, Homo sapiens
tctgggcaaggagagcg

SEQ ID NO: 487 - DNA, 17 bp, Homo sapiens
ctgggcaaggagagcga

SEQ ID NO: 488 - DNA, 17 bp, Homo sapiens
tgggcaaggagagcgag

SEQ ID NO: 489 - DNA, 17 bp, Homo sapiens
gggcaaggagagcgagg

SEQ ID NO: 490 - DNA, 17 bp, Homo sapiens
ggcaaggagagcgaggg

SEQ ID NO: 491 - DNA, 17 bp, Homo sapiens
gcaaggagagcgagggg

SEQ ID NO: 492 - DNA, 17 bp, Homo sapiens
caaggagagcgaggggt

SEQ ID NO: 493 - DNA, 17 bp, Homo sapiens
aaggagagcgaggggtc

SEQ ID NO: 494 - DNA, 17 bp, Homo sapiens
aggagagcgaggggtcc

SEQ ID NO: 495 - DNA, 17 bp, Homo sapiens
ggagagcgaggggtccc

SEQ ID NO: 496 - DNA, 17 bp, Homo sapiens
gagagcgaggggtcccg

SEQ ID NO: 497 - DNA, 17 bp, Homo sapiens
agagcgaggggtcccgc

SEQ ID NO: 498 - DNA, 17 bp, Homo sapiens
gagcgaggggtcccgca

SEQ ID NO: 499 - DNA, 17 bp, Homo sapiens
agcgaggggtcccgcag

SEQ ID NO: 500 - DNA, 17 bp, Homo sapiens
gcgaggggtcccgcagc

SEQ ID NO: 501 - DNA, 17 bp, Homo sapiens
cgaggggtcccgcagcc

SEQ ID NO: 502 - DNA, 17 bp, Homo sapiens
gaggggtcccgcagccc

SEQ ID NO: 503 - DNA, 17 bp, Homo sapiens
aggggtcccgcagcccc

SEQ ID NO: 504 - DNA, 17 bp, Homo sapiens
ggggtcccgcagccccg

SEQ ID NO: 505 - DNA, 17 bp, Homo sapiens
gggtcccgcagccccga

SEQ ID NO: 506 - DNA, 17 bp, Homo sapiens
ggtcccgcagccccgac

SEQ ID NO: 507 - DNA, 17 bp, Homo sapiens
gtcccgcagccccgacc

SEQ ID NO: 508 - DNA, 17 bp, Homo sapiens
tcccgcagccccgaccc

SEQ ID NO: 509 - DNA, 17 bp, Homo sapiens
cccgcagccccgaccct

SEQ ID NO: 510 - DNA, 17 bp, Homo sapiens
ccgcagccccgaccctg

SEQ ID NO: 511 - DNA, 17 bp, Homo sapiens
cgcagccccgaccctga

SEQ ID NO: 512 - DNA, 17 bp, Homo sapiens
gcagccccgaccctgag

SEQ ID NO: 513 - DNA, 17 bp, Homo sapiens
cagccccgaccctgagc

SEQ ID NO: 514 - DNA, 17 bp, Homo sapiens
agccccgaccctgagca

SEQ ID NO: 515 - DNA, 17 bp, Homo sapiens
gccccgaccctgagcag

SEQ ID NO: 516 - DNA, 17 bp, Homo sapiens
ccccgaccctgagcaga

SEQ ID NO: 517 - DNA, 17 bp, Homo sapiens
cccgaccctgagcagat

SEQ ID NO: 518 - DNA, 17 bp, Homo sapiens
ccgaccctgagcagatg

SEQ ID NO: 519 - DNA, 17 bp, Homo sapiens
cgaccctgagcagatga

SEQ ID NO: 520 - DNA, 17 bp, Homo sapiens
gaccctgagcagatgac

SEQ ID NO: 521 - DNA, 17 bp, Homo sapiens
accctgagcagatgaca

SEQ ID NO: 522 - DNA, 17 bp, Homo sapiens
ccctgagcagatgacaa

SEQ ID NO: 523 - DNA, 17 bp, Homo sapiens
cctgagcagatgacaag

SEQ ID NO: 524 - DNA, 17 bp, Homo sapiens
ctgagcagatgacaagc

SEQ ID NO: 525 - DNA, 17 bp, Homo sapiens
tgagcagatgacaagca

SEQ ID NO: 526 - DNA, 17 bp, Homo sapiens
gagcagatgacaagcat

SEQ ID NO: 527 - DNA, 17 bp, Homo sapiens
agcagatgacaagcatc

SEQ ID NO: 528 - DNA, 17 bp, Homo sapiens
gcagatgacaagcatca

SEQ ID NO: 529 - DNA, 17 bp, Homo sapiens
cagatgacaagcatcaa

SEQ ID NO: 530 - DNA, 17 bp, Homo sapiens
agatgacaagcatcaat

SEQ ID NO: 531 - DNA, 17 bp, Homo sapiens
gatgacaagcatcaatg

SEQ ID NO: 532 - DNA, 17 bp, Homo sapiens
atgacaagcatcaatgg

SEQ ID NO: 533 - DNA, 17 bp, Homo sapiens
tgacaagcatcaatggt

SEQ ID NO: 534 - DNA, 17 bp, Homo sapiens
gacaagcatcaatggtg

SEQ ID NO: 535 - DNA, 17 bp, Homo sapiens
acaagcatcaatggtga

SEQ ID NO: 536 - DNA, 17 bp, Homo sapiens
caagcatcaatggtgag

SEQ ID NO: 537 - DNA, 17 bp, Homo sapiens
aagcatcaatggtgaga

SEQ ID NO: 538 - DNA, 17 bp, Homo sapiens
agcatcaatggtgagaa

SEQ ID NO: 539 - DNA, 17 bp, Homo sapiens
gcatcaatggtgagaag

SEQ ID NO: 540 - DNA, 17 bp, Homo sapiens
catcaatggtgagaagg

SEQ ID NO: 541 - DNA, 17 bp, Homo sapiens
atcaatggtgagaaggc

SEQ ID NO: 542 - DNA, 17 bp, Homo sapiens
tcaatggtgagaaggcc

SEQ ID NO: 543 - DNA, 17 bp, Homo sapiens
caatggtgagaaggccc

SEQ ID NO: 544 - DNA, 17 bp, Homo sapiens
aatggtgagaaggccca

SEQ ID NO: 545 - DNA, 17 bp, Homo sapiens
atggtgagaaggcccag

SEQ ID NO: 546 - DNA, 17 bp, Homo sapiens
tggtgagaaggcccagg

SEQ ID NO: 547 - DNA, 17 bp, Homo sapiens
ggtgagaaggcccagga

SEQ ID NO: 548 - DNA, 17 bp, Homo sapiens
gtgagaaggcccaggag

SEQ ID NO: 549 - DNA, 17 bp, Homo sapiens
tgagaaggcccaggagc

SEQ ID NO: 550 - DNA, 17 bp, Homo sapiens
gagaaggcccaggagct

SEQ ID NO: 551 - DNA, 17 bp, Homo sapiens
agaaggcccaggagctg

SEQ ID NO: 552 - DNA, 17 bp, Homo sapiens
gaaggcccaggagctgg

SEQ ID NO: 553 - DNA, 17 bp, Homo sapiens
aaggcccaggagctggg

SEQ ID NO: 554 - DNA, 17 bp, Homo sapiens
aggcccaggagctgggc

SEQ ID NO: 555 - DNA, 17 bp, Homo sapiens
ggcccaggagctgggct

SEQ ID NO: 556 - DNA, 17 bp, Homo sapiens
gcccaggagctgggctc

SEQ ID NO: 557 - DNA, 17 bp, Homo sapiens
cccaggagctgggctcc

SEQ ID NO: 558 - DNA, 17 bp, Homo sapiens
ccaggagctgggctcca

SEQ ID NO: 559 - DNA, 17 bp, Homo sapiens
caggagctgggctccag

SEQ ID NO: 560 - DNA, 17 bp, Homo sapiens
aggagctgggctccagt

SEQ ID NO: 561 - DNA, 17 bp, Homo sapiens
ggagctgggctccagtg

SEQ ID NO: 562 - DNA, 17 bp, Homo sapiens
gagctgggctccagtgc

SEQ ID NO: 563 - DNA, 17 bp, Homo sapiens
agctgggctccagtgcg

SEQ ID NO: 564 - DNA, 17 bp, Homo sapiens
gctgggctccagtgcga

SEQ ID NO: 565 - DNA, 17 bp, Homo sapiens
ctgggctccagtgcgac

SEQ ID NO: 566 - DNA, 17 bp, Homo sapiens
tgggctccagtgcgaca

SEQ ID NO: 567 - DNA, 17 bp, Homo sapiens
gggctccagtgcgacac

SEQ ID NO: 568 - DNA, 17 bp, Homo sapiens
ggctccagtgcgacacc

SEQ ID NO: 569 - DNA, 17 bp, Homo sapiens
gctccagtgcgacacca

SEQ ID NO: 570 - DNA, 17 bp, Homo sapiens
ctccagtgcgacaccaa

SEQ ID NO: 571 - DNA, 17 bp, Homo sapiens
tccagtgcgacaccaac

SEQ ID NO: 572 - DNA, 17 bp, Homo sapiens
ccagtgcgacaccaacc

SEQ ID NO: 573 - DNA, 17 bp, Homo sapiens
cagtgcgacaccaacca

SEQ ID NO: 574 - DNA, 17 bp, Homo sapiens
agtgcgacaccaaccaa

SEQ ID NO: 575 - DNA, 17 bp, Homo sapiens
gtgcgacaccaaccaaa

SEQ ID NO: 576 - DNA, 17 bp, Homo sapiens
tgcgacaccaaccaaaa

SEQ ID NO: 577 - DNA, 17 bp, Homo sapiens
gcgacaccaaccaaaaa

SEQ ID NO: 578 - DNA, 17 bp, Homo sapiens
cgacaccaaccaaaaag

SEQ ID NO: 579 - DNA, 17 bp, Homo sapiens
gacaccaaccaaaaaga

SEQ ID NO: 580 - DNA, 17 bp, Homo sapiens
acaccaaccaaaaagac

SEQ ID NO: 581 - DNA, 17 bp, Homo sapiens
caccaaccaaaaagact

SEQ ID NO: 582 - DNA, 17 bp, Homo sapiens
accaaccaaaaagactg

SEQ ID NO: 583 - DNA, 17 bp, Homo sapiens
ccaaccaaaaagactgt

SEQ ID NO: 584 - DNA, 17 bp, Homo sapiens
caaccaaaaagactgtc

SEQ ID NO: 585 - DNA, 17 bp, Homo sapiens
aaccaaaaagactgtcc

SEQ ID NO: 586 - DNA, 17 bp, Homo sapiens
accaaaaagactgtccc

SEQ ID NO: 587 - DNA, 17 bp, Homo sapiens
ccaaaaagactgtcccc

SEQ ID NO: 588 - DNA, 17 bp, Homo sapiens
caaaaagactgtcccct

SEQ ID NO: 589 - DNA, 17 bp, Homo sapiens
aaaaagactgtcccctt

SEQ ID NO: 590 - DNA, 17 bp, Homo sapiens
aaaagactgtccccttc

SEQ ID NO: 591 - DNA, 17 bp, Homo sapiens
aaagactgtccccttca

SEQ ID NO: 592 - DNA, 17 bp, Homo sapiens
aagactgtccccttcaa

SEQ ID NO: 593 - DNA, 17 bp, Homo sapiens
agactgtccccttcaag

SEQ ID NO: 594 - DNA, 17 bp, Homo sapiens
gactgtccccttcaaga

SEQ ID NO: 595 - DNA, 17 bp, Homo sapiens
actgtccccttcaagag

SEQ ID NO: 596 - DNA, 17 bp, Homo sapiens
ctgtccccttcaagagg

SEQ ID NO: 597 - DNA, 17 bp, Homo sapiens
tgtccccttcaagaggg

SEQ ID NO: 598 - DNA, 17 bp, Homo sapiens
gtccccttcaagagggg

SEQ ID NO: 599 - DNA, 17 bp, Homo sapiens
tccccttcaagaggggc

SEQ ID NO: 600 - DNA, 17 bp, Homo sapiens
ccccttcaagaggggcg

SEQ ID NO: 601 - DNA, 17 bp, Homo sapiens
cccttcaagaggggcgt

SEQ ID NO: 602 - DNA, 17 bp, Homo sapiens
ccttcaagaggggcgtg

SEQ ID NO: 603 - DNA, 17 bp, Homo sapiens
cttcaagaggggcgtga

SEQ ID NO: 604 - DNA, 17 bp, Homo sapiens
ttcaagaggggcgtgag

SEQ ID NO: 605 - DNA, 17 bp, Homo sapiens
tcaagaggggcgtgagg

SEQ ID NO: 606 - DNA, 17 bp, Homo sapiens
caagaggggcgtgagga

SEQ ID NO: 607 - DNA, 17 bp, Homo sapiens
aagaggggcgtgaggag

SEQ ID NO: 608 - DNA, 17 bp, Homo sapiens
agaggggcgtgaggagg

SEQ ID NO: 609 - DNA, 17 bp, Homo sapiens
gaggggcgtgaggaggg

SEQ ID NO: 610 - DNA, 17 bp, Homo sapiens
aggggcgtgaggagggg

SEQ ID NO: 611 - DNA, 17 bp, Homo sapiens
ggggcgtgaggaggggt

SEQ ID NO: 612 - DNA, 17 bp, Homo sapiens
gggcgtgaggaggggtg

SEQ ID NO: 613 - DNA, 17 bp, Homo sapiens
ggcgtgaggaggggtga

SEQ ID NO: 614 - DNA, 17 bp, Homo sapiens
gcgtgaggaggggtgat

SEQ ID NO: 615 - DNA, 17 bp, Homo sapiens
cgtgaggaggggtgatg

SEQ ID NO: 616 - DNA, 17 bp, Homo sapiens
gtgaggaggggtgatgt

SEQ ID NO: 617 - DNA, 17 bp, Homo sapiens
tgaggaggggtgatgtg

SEQ ID NO: 618 - DNA, 17 bp, Homo sapiens
gaggaggggtgatgtgt

SEQ ID NO: 619 - DNA, 17 bp, Homo sapiens
aggaggggtgatgtgtt

SEQ ID NO: 620 - DNA, 17 bp, Homo sapiens
ggaggggtgatgtgttg

SEQ ID NO: 621 - DNA, 17 bp, Homo sapiens
gaggggtgatgtgttgt

SEQ ID NO: 622 - DNA, 17 bp, Homo sapiens
aggggtgatgtgttgtt

SEQ ID NO: 623 - DNA, 17 bp, Homo sapiens
ggggtgatgtgttgttg

SEQ ID NO: 624 - DNA, 17 bp, Homo sapiens
gggtgatgtgttgttga

SEQ ID NO: 625 - DNA, 17 bp, Homo sapiens
ggtgatgtgttgttgat

SEQ ID NO: 626 - DNA, 17 bp, Homo sapiens
gtgatgtgttgttgatg

SEQ ID NO: 627 - DNA, 17 bp, Homo sapiens
tgatgtgttgttgatgg

SEQ ID NO: 628 - DNA, 17 bp, Homo sapiens
gatgtgttgttgatggt

SEQ ID NO: 629 - DNA, 17 bp, Homo sapiens
atgtgttgttgatggtg

SEQ ID NO: 630 - DNA, 17 bp, Homo sapiens
tgtgttgttgatggtgg

SEQ ID NO: 631 - DNA, 17 bp, Homo sapiens
gtgttgttgatggtggc

SEQ ID NO: 632 - DNA, 17 bp, Homo sapiens
tgttgttgatggtggcc

SEQ ID NO: 633 - DNA, 17 bp, Homo sapiens
gttgttgatggtggcca

SEQ ID NO: 634 - DNA, 17 bp, Homo sapiens
ttgttgatggtggccaa

SEQ ID NO: 635 - DNA, 17 bp, Homo sapiens
tgttgatggtggccaag

SEQ ID NO: 636 - DNA, 17 bp, Homo sapiens
gttgatggtggccaagc

SEQ ID NO: 637 - DNA, 17 bp, Homo sapiens
ttgatggtggccaagct

SEQ ID NO: 638 - DNA, 17 bp, Homo sapiens
tgatggtggccaagctg

SEQ ID NO: 639 - DNA, 17 bp, Homo sapiens
gatggtggccaagctgg

SEQ ID NO: 640 - DNA, 17 bp, Homo sapiens
atggtggccaagctgga

SEQ ID NO: 641 - DNA, 17 bp, Homo sapiens
tggtggccaagctggac

SEQ ID NO: 642 - DNA, 17 bp, Homo sapiens
ggtggccaagctggacc

SEQ ID NO: 643 - DNA, 17 bp, Homo sapiens
gtggccaagctggaccc

SEQ ID NO: 644 - DNA, 17 bp, Homo sapiens
tggccaagctggacccg

SEQ ID NO: 645 - DNA, 17 bp, Homo sapiens
ggccaagctggacccgg

SEQ ID NO: 646 - DNA, 17 bp, Homo sapiens
gccaagctggacccgga

SEQ ID NO: 647 - DNA, 17 bp, Homo sapiens
ccaagctggacccggac

SEQ ID NO: 648 - DNA, 17 bp, Homo sapiens
caagctggacccggact

SEQ ID NO: 649 - DNA, 17 bp, Homo sapiens
aagctggacccggactc

SEQ ID NO: 650 - DNA, 17 bp, Homo sapiens
agctggacccggactca

SEQ ID NO: 651 - DNA, 17 bp, Homo sapiens
gctggacccggactcag

SEQ ID NO: 652 - DNA, 17 bp, Homo sapiens
ctggacccggactcagc

SEQ ID NO: 653 - DNA, 17 bp, Homo sapiens
tggacccggactcagcc

SEQ ID NO: 654 - DNA, 17 bp, Homo sapiens
ggacccggactcagcca

SEQ ID NO: 655 - DNA, 17 bp, Homo sapiens
gacccggactcagccaa

SEQ ID NO: 656 - DNA, 17 bp, Homo sapiens
acccggactcagccaag

SEQ ID NO: 657 - DNA, 17 bp, Homo sapiens
cccggactcagccaagc

SEQ ID NO: 658 - DNA, 17 bp, Homo sapiens
ccggactcagccaagcc

SEQ ID NO: 659 - DNA, 17 bp, Homo sapiens
cggactcagccaagcca

SEQ ID NO: 660 - DNA, 17 bp, Homo sapiens
ggactcagccaagccag

SEQ ID NO: 661 - DNA, 17 bp, Homo sapiens
gactcagccaagccaga

SEQ ID NO: 662 - DNA, 17 bp, Homo sapiens
actcagccaagccagag

SEQ ID NO: 663 - DNA, 17 bp, Homo sapiens
ctcagccaagccagaga

SEQ ID NO: 664 - DNA, 17 bp, Homo sapiens
tcagccaagccagagaa

SEQ ID NO: 665 - DNA, 17 bp, Homo sapiens
cagccaagccagagaag

SEQ ID NO: 666 - DNA, 17 bp, Homo sapiens
agccaagccagagaaga

SEQ ID NO: 667 - DNA, 17 bp, Homo sapiens
gccaagccagagaagac

SEQ ID NO: 668 - DNA, 17 bp, Homo sapiens
ccaagccagagaagact

SEQ ID NO: 669 - DNA, 17 bp, Homo sapiens
caagccagagaagactc

SEQ ID NO: 670 - DNA, 17 bp, Homo sapiens
aagccagagaagactca

SEQ ID NO: 671 - DNA, 17 bp, Homo sapiens
agccagagaagactcat

SEQ ID NO: 672 - DNA, 17 bp, Homo sapiens
gccagagaagactcatc

SEQ ID NO: 673 - DNA, 17 bp, Homo sapiens
ccagagaagactcatcc

SEQ ID NO: 674 - DNA, 17 bp, Homo sapiens
cagagaagactcatccc

SEQ ID NO: 675 - DNA, 17 bp, Homo sapiens
agagaagactcatcccc

SEQ ID NO: 676 - DNA, 17 bp, Homo sapiens
gagaagactcatcccca

SEQ ID NO: 677 - DNA, 17 bp, Homo sapiens
agaagactcatccccat

SEQ ID NO: 678 - DNA, 17 bp, Homo sapiens
gaagactcatccccatg

SEQ ID NO: 679 - DNA, 17 bp, Homo sapiens
aagactcatccccatga

SEQ ID NO: 680 - DNA, 17 bp, Homo sapiens
agactcatccccatgac

SEQ ID NO: 681 - DNA, 17 bp, Homo sapiens
gactcatccccatgacg

SEQ ID NO: 682 - DNA, 17 bp, Homo sapiens
actcatccccatgacgc

SEQ ID NO: 683 - DNA, 17 bp, Homo sapiens
ctcatccccatgacgcc

SEQ ID NO: 684 - DNA, 17 bp, Homo sapiens
tcatccccatgacgccc

SEQ ID NO: 685 - DNA, 17 bp, Homo sapiens
catccccatgacgcccc

SEQ ID NO: 686 - DNA, 17 bp, Homo sapiens
atccccatgacgccccc

SEQ ID NO: 687 - DNA, 17 bp, Homo sapiens
tccccatgacgcccccc

SEQ ID NO: 688 - DNA, 17 bp, Homo sapiens
ccccatgacgccccccc

SEQ ID NO: 689 - DNA, 17 bp, Homo sapiens
cccatgacgccccccct

SEQ ID NO: 690 - DNA, 17 bp, Homo sapiens
ccatgacgccccccctt

SEQ ID NO: 691 - DNA, 17 bp, Homo sapiens
catgacgcccccccttg

SEQ ID NO: 692 - DNA, 17 bp, Homo sapiens
atgacgcccccccttgc

SEQ ID NO: 693 - DNA, 17 bp, Homo sapiens
tgacgcccccccttgca

SEQ ID NO: 694 - DNA, 17 bp, Homo sapiens
gacgcccccccttgcaa

SEQ ID NO: 695 - DNA, 17 bp, Homo sapiens
acgcccccccttgcaag

SEQ ID NO: 696 - DNA, 17 bp, Homo sapiens
cgcccccccttgcaaga

SEQ ID NO: 697 - DNA, 17 bp, Homo sapiens
gcccccccttgcaagac

SEQ ID NO: 698 - DNA, 17 bp, Homo sapiens
cccccccttgcaagacc

SEQ ID NO: 699 - DNA, 17 bp, Homo sapiens
ccccccttgcaagacct

SEQ ID NO: 700 - DNA, 17 bp, Homo sapiens
cccccttgcaagacctc

SEQ ID NO: 701 - DNA, 17 bp, Homo sapiens
ccccttgcaagacctct

SEQ ID NO: 702 - DNA, 17 bp, Homo sapiens
cccttgcaagacctctc

SEQ ID NO: 703 - DNA, 17 bp, Homo sapiens
ccttgcaagacctctcc

SEQ ID NO: 704 - DNA, 17 bp, Homo sapiens
cttgcaagacctctccc

SEQ ID NO: 705 - DNA, 17 bp, Homo sapiens
ttgcaagacctctcccc

SEQ ID NO: 706 - DNA, 17 bp, Homo sapiens
tgcaagacctctccccc

SEQ ID NO: 707 - DNA, 17 bp, Homo sapiens
gcaagacctctcccccc

SEQ ID NO: 708 - DNA, 17 bp, Homo sapiens
caagacctctccccccg

SEQ ID NO: 709 - DNA, 17 bp, Homo sapiens
aagacctctccccccgc

SEQ ID NO: 710 - DNA, 17 bp, Homo sapiens
agacctctccccccgcc

SEQ ID NO: 711 - DNA, 17 bp, Homo sapiens
gacctctccccccgcca

SEQ ID NO: 712 - DNA, 17 bp, Homo sapiens
acctctccccccgccac

SEQ ID NO: 713 - DNA, 17 bp, Homo sapiens
cctctccccccgccaca

SEQ ID NO: 714 - DNA, 17 bp, Homo sapiens
ctctccccccgccacag

SEQ ID NO: 715 - DNA, 17 bp, Homo sapiens
tctccccccgccacaga

SEQ ID NO: 716 - DNA, 17 bp, Homo sapiens
ctccccccgccacagat

SEQ ID NO: 717 - DNA, 17 bp, Homo sapiens
tccccccgccacagata

SEQ ID NO: 718 - DNA, 17 bp, Homo sapiens
ccccccgccacagatac

SEQ ID NO: 719 - DNA, 17 bp, Homo sapiens
cccccgccacagatact

SEQ ID NO: 720 - DNA, 17 bp, Homo sapiens
ccccgccacagatactg

SEQ ID NO: 721 - DNA, 17 bp, Homo sapiens
cccgccacagatactgg

SEQ ID NO: 722 - DNA, 17 bp, Homo sapiens
ccgccacagatactgga

SEQ ID NO: 723 - DNA, 17 bp, Homo sapiens
cgccacagatactggaa

SEQ ID NO: 724 - DNA, 17 bp, Homo sapiens
gccacagatactggaaa

SEQ ID NO: 725 - DNA, 17 bp, Homo sapiens
ccacagatactggaaag

SEQ ID NO: 726 - DNA, 17 bp, Homo sapiens
cacagatactggaaagg

SEQ ID NO: 727 - DNA, 17 bp, Homo sapiens
acagatactggaaagga

SEQ ID NO: 728 - DNA, 17 bp, Homo sapiens
cagatactggaaaggaa

SEQ ID NO: 729 - DNA, 17 bp, Homo sapiens
agatactggaaaggaaa

SEQ ID NO: 730 - DNA, 17 bp, Homo sapiens
gatactggaaaggaaaa

SEQ ID NO: 731 - DNA, 17 bp, Homo sapiens
atactggaaaggaaaag

SEQ ID NO: 732 - DNA, 17 bp, Homo sapiens
tactggaaaggaaaaga

SEQ ID NO: 733 - DNA, 17 bp, Homo sapiens
actggaaaggaaaagaa

SEQ ID NO: 734 - DNA, 17 bp, Homo sapiens
ctggaaaggaaaagaaa

SEQ ID NO: 735 - DNA, 17 bp, Homo sapiens
tggaaaggaaaagaaag

SEQ ID NO: 736 - DNA, 17 bp, Homo sapiens
ggaaaggaaaagaaagg

SEQ ID NO: 737 - DNA, 17 bp, Homo sapiens
gaaaggaaaagaaaggg

SEQ ID NO: 738 - DNA, 17 bp, Homo sapiens
aaaggaaaagaaagggg

SEQ ID NO: 739 - DNA, 17 bp, Homo sapiens
aaggaaaagaaagggga

SEQ ID NO: 740 - DNA, 17 bp, Homo sapiens
aggaaaagaaaggggag

SEQ ID NO: 741 - DNA, 17 bp, Homo sapiens
ggaaaagaaaggggaga

SEQ ID NO: 742 - DNA, 17 bp, Homo sapiens
gaaaagaaaggggagac

SEQ ID NO: 743 - DNA, 17 bp, Homo sapiens
aaaagaaaggggagacc

SEQ ID NO: 744 - DNA, 17 bp, Homo sapiens
aaagaaaggggagacct

SEQ ID NO: 745 - DNA, 17 bp, Homo sapiens
aagaaaggggagacctc

SEQ ID NO: 746 - DNA, 17 bp, Homo sapiens
agaaaggggagacctct

SEQ ID NO: 747 - DNA, 17 bp, Homo sapiens
gaaaggggagacctcta

SEQ ID NO: 748 - DNA, 17 bp, Homo sapiens
aaaggggagacctctag

SEQ ID NO: 749 - DNA, 17 bp, Homo sapiens
aaggggagacctctagg

SEQ ID NO: 750 - DNA, 17 bp, Homo sapiens
aggggagacctctagga

SEQ ID NO: 751 - DNA, 17 bp, Homo sapiens
ggggagacctctaggac

SEQ ID NO: 752 - DNA, 17 bp, Homo sapiens
gggagacctctaggact

SEQ ID NO: 753 - DNA, 17 bp, Homo sapiens
ggagacctctaggactc

SEQ ID NO: 754 - DNA, 17 bp, Homo sapiens
gagacctctaggactcc

SEQ ID NO: 755 - DNA, 17 bp, Homo sapiens
agacctctaggactcct

SEQ ID NO: 756 - DNA, 17 bp, Homo sapiens
gacctctaggactcctt

SEQ ID NO: 757 - DNA, 17 bp, Homo sapiens
acctctaggactccttg

SEQ ID NO: 758 - DNA, 17 bp, Homo sapiens
cctctaggactccttgt

SEQ ID NO: 759 - DNA, 17 bp, Homo sapiens
ctctaggactccttgtg

SEQ ID NO: 760 - DNA, 17 bp, Homo sapiens
tctaggactccttgtgg

SEQ ID NO: 761 - DNA, 17 bp, Homo sapiens
ctaggactccttgtggc

SEQ ID NO: 762 - DNA, 17 bp, Homo sapiens
taggactccttgtggct

SEQ ID NO: 763 - DNA, 17 bp, Homo sapiens
aggactccttgtggctc

SEQ ID NO: 764 - DNA, 17 bp, Homo sapiens
ggactccttgtggctcc

SEQ ID NO: 765 - DNA, 17 bp, Homo sapiens
gactccttgtggctccc

SEQ ID NO: 766 - DNA, 17 bp, Homo sapiens
actccttgtggctccca

SEQ ID NO: 767 - DNA, 17 bp, Homo sapiens
ctccttgtggctcccag

SEQ ID NO: 768 - DNA, 17 bp, Homo sapiens
tccttgtggctcccagg

SEQ ID NO: 769 - DNA, 17 bp, Homo sapiens
ccttgtggctcccaggc

SEQ ID NO: 770 - DNA, 17 bp, Homo sapiens
cttgtggctcccaggcc

SEQ ID NO: 771 - DNA, 17 bp, Homo sapiens
ttgtggctcccaggcca

SEQ ID NO: 772 - DNA, 17 bp, Homo sapiens
tgtggctcccaggccag

SEQ ID NO: 773 - DNA, 17 bp, Homo sapiens
gtggctcccaggccagc

SEQ ID NO: 774 - DNA, 17 bp, Homo sapiens
tggctcccaggccagca

SEQ ID NO: 775 - DNA, 17 bp, Homo sapiens
ggctcccaggccagcac

SEQ ID NO: 776 - DNA, 17 bp, Homo sapiens
gctcccaggccagcacc

SEQ ID NO: 777 - DNA, 17 bp, Homo sapiens
ctcccaggccagcaccg

SEQ ID NO: 778 - DNA, 17 bp, Homo sapiens
tcccaggccagcaccga

SEQ ID NO: 779 - DNA, 17 bp, Homo sapiens
cccaggccagcaccgag

SEQ ID NO: 780 - DNA, 17 bp, Homo sapiens
ccaggccagcaccgaga

SEQ ID NO: 781 - DNA, 17 bp, Homo sapiens
caggccagcaccgagat

SEQ ID NO: 782 - DNA, 17 bp, Homo sapiens
aggccagcaccgagatc

SEQ ID NO: 783 - DNA, 17 bp, Homo sapiens
ggccagcaccgagatct

SEQ ID NO: 784 - DNA, 17 bp, Homo sapiens
gccagcaccgagatctt

SEQ ID NO: 785 - DNA, 17 bp, Homo sapiens
ccagcaccgagatcttg

SEQ ID NO: 786 - DNA, 17 bp, Homo sapiens
cagcaccgagatcttgg

SEQ ID NO: 787 - DNA, 17 bp, Homo sapiens
agcaccgagatcttggc

SEQ ID NO: 788 - DNA, 17 bp, Homo sapiens
gcaccgagatcttggcc

SEQ ID NO: 789 - DNA, 17 bp, Homo sapiens
caccgagatcttggccc

SEQ ID NO: 790 - DNA, 17 bp, Homo sapiens
accgagatcttggcccc

SEQ ID NO: 791 - DNA, 17 bp, Homo sapiens
ccgagatcttggccccg

SEQ ID NO: 792 - DNA, 17 bp, Homo sapiens
cgagatcttggccccga

SEQ ID NO: 793 - DNA, 17 bp, Homo sapiens
gagatcttggccccgaa

SEQ ID NO: 794 - DNA, 17 bp, Homo sapiens
agatcttggccccgaaa

SEQ ID NO: 795 - DNA, 17 bp, Homo sapiens
gatcttggccccgaaag

SEQ ID NO: 796 - DNA, 17 bp, Homo sapiens
atcttggccccgaaagc

SEQ ID NO: 797 - DNA, 17 bp, Homo sapiens
tcttggccccgaaagct

SEQ ID NO: 798 - DNA, 17 bp, Homo sapiens
cttggccccgaaagctg

SEQ ID NO: 799 - DNA, 17 bp, Homo sapiens
ttggccccgaaagctga

SEQ ID NO: 800 - DNA, 17 bp, Homo sapiens
tggccccgaaagctgag

SEQ ID NO: 801 - DNA, 17 bp, Homo sapiens
ggccccgaaagctgaga

SEQ ID NO: 802 - DNA, 17 bp, Homo sapiens
gccccgaaagctgagaa

SEQ ID NO: 803 - DNA, 17 bp, Homo sapiens
ccccgaaagctgagaag

SEQ ID NO: 804 - DNA, 17 bp, Homo sapiens
cccgaaagctgagaaga

SEQ ID NO: 805 - DNA, 17 bp, Homo sapiens
ccgaaagctgagaagac

SEQ ID NO: 806 - DNA, 17 bp, Homo sapiens
cgaaagctgagaagacc

SEQ ID NO: 807 - DNA, 17 bp, Homo sapiens
gaaagctgagaagaccc

SEQ ID NO: 808 - DNA, 17 bp, Homo sapiens
aaagctgagaagacccg

SEQ ID NO: 809 - DNA, 17 bp, Homo sapiens
aagctgagaagacccgg

SEQ ID NO: 810 - DNA, 17 bp, Homo sapiens
agctgagaagacccgga

SEQ ID NO: 811 - DNA, 17 bp, Homo sapiens
gctgagaagacccggac

SEQ ID NO: 812 - DNA, 17 bp, Homo sapiens
ctgagaagacccggact

SEQ ID NO: 813 - DNA, 17 bp, Homo sapiens
tgagaagacccggactg

SEQ ID NO: 814 - DNA, 17 bp, Homo sapiens
gagaagacccggactgg

SEQ ID NO: 815 - DNA, 17 bp, Homo sapiens
agaagacccggactggg

SEQ ID NO: 816 - DNA, 17 bp, Homo sapiens
gaagacccggactgggg

SEQ ID NO: 817 - DNA, 17 bp, Homo sapiens
aagacccggactggggg

SEQ ID NO: 818 - DNA, 17 bp, Homo sapiens
agacccggactgggggt

SEQ ID NO: 819 - DNA, 17 bp, Homo sapiens
gacccggactgggggtc

SEQ ID NO: 820 - DNA, 17 bp, Homo sapiens
acccggactgggggtct

SEQ ID NO: 821 - DNA, 17 bp, Homo sapiens
cccggactgggggtctt

SEQ ID NO: 822 - DNA, 17 bp, Homo sapiens
ccggactgggggtcttg

SEQ ID NO: 823 - DNA, 17 bp, Homo sapiens
cggactgggggtcttgg

SEQ ID NO: 824 - DNA, 17 bp, Homo sapiens
ggactgggggtcttggg

SEQ ID NO: 825 - DNA, 17 bp, Homo sapiens
gactgggggtcttgggg

SEQ ID NO: 826 - DNA, 17 bp, Homo sapiens
actgggggtcttgggga

SEQ ID NO: 827 - DNA, 17 bp, Homo sapiens
ctgggggtcttggggac

SEQ ID NO: 828 - DNA, 17 bp, Homo sapiens
tgggggtcttggggacc

SEQ ID NO: 829 - DNA, 17 bp, Homo sapiens
gggggtcttggggaccc

SEQ ID NO: 830 - DNA, 17 bp, Homo sapiens
ggggtcttggggaccca

SEQ ID NO: 831 - DNA, 17 bp, Homo sapiens
gggtcttggggacccag

SEQ ID NO: 832 - DNA, 17 bp, Homo sapiens
ggtcttggggacccagg

SEQ ID NO: 833 - DNA, 17 bp, Homo sapiens
gtcttggggacccaggc

SEQ ID NO: 834 - DNA, 17 bp, Homo sapiens
tcttggggacccaggcc

SEQ ID NO: 835 - DNA, 17 bp, Homo sapiens
cttggggacccaggcca

SEQ ID NO: 836 - DNA, 17 bp, Homo sapiens
ttggggacccaggccaa

SEQ ID NO: 837 - DNA, 17 bp, Homo sapiens
tggggacccaggccaag

SEQ ID NO: 838 - DNA, 17 bp, Homo sapiens
ggggacccaggccaagg

SEQ ID NO: 839 - DNA, 17 bp, Homo sapiens
gggacccaggccaagga

SEQ ID NO: 840 - DNA, 17 bp, Homo sapiens
ggacccaggccaaggaa

SEQ ID NO: 841 - DNA, 17 bp, Homo sapiens
gacccaggccaaggaac

SEQ ID NO: 842 - DNA, 17 bp, Homo sapiens
acccaggccaaggaact

SEQ ID NO: 843 - DNA, 17 bp, Homo sapiens
cccaggccaaggaactg

SEQ ID NO: 844 - DNA, 17 bp, Homo sapiens
ccaggccaaggaactgt

SEQ ID NO: 845 - DNA, 17 bp, Homo sapiens
caggccaaggaactgtg

SEQ ID NO: 846 - DNA, 17 bp, Homo sapiens
aggccaaggaactgtgg

SEQ ID NO: 847 - DNA, 17 bp, Homo sapiens
ggccaaggaactgtggc

SEQ ID NO: 848 - DNA, 17 bp, Homo sapiens
gccaaggaactgtggca

SEQ ID NO: 849 - DNA, 17 bp, Homo sapiens
ccaaggaactgtggcac

SEQ ID NO: 850 - DNA, 17 bp, Homo sapiens
caaggaactgtggcact

SEQ ID NO: 851 - DNA, 17 bp, Homo sapiens
aaggaactgtggcactg

SEQ ID NO: 852 - DNA, 17 bp, Homo sapiens
aggaactgtggcactga

SEQ ID NO: 853 - DNA, 17 bp, Homo sapiens
ggaactgtggcactgaa

SEQ ID NO: 854 - DNA, 17 bp, Homo sapiens
gaactgtggcactgaaa

SEQ ID NO: 855 - DNA, 17 bp, Homo sapiens
aactgtggcactgaaaa

SEQ ID NO: 856 - DNA, 17 bp, Homo sapiens
actgtggcactgaaaaa

SEQ ID NO: 857 - DNA, 17 bp, Homo sapiens
ctgtggcactgaaaaaa

SEQ ID NO: 858 - DNA, 17 bp, Homo sapiens
tgtggcactgaaaaaag

SEQ ID NO: 859 - DNA, 17 bp, Homo sapiens
gtggcactgaaaaaagg

SEQ ID NO: 860 - DNA, 17 bp, Homo sapiens
tggcactgaaaaaaggc

SEQ ID NO: 861 - DNA, 17 bp, Homo sapiens
ggcactgaaaaaaggcg

SEQ ID NO: 862 - DNA, 17 bp, Homo sapiens
gcactgaaaaaaggcga

SEQ ID NO: 863 - DNA, 17 bp, Homo sapiens
cactgaaaaaaggcgag

SEQ ID NO: 864 - DNA, 17 bp, Homo sapiens
actgaaaaaaggcgagg

SEQ ID NO: 865 - DNA, 17 bp, Homo sapiens
ctgaaaaaaggcgagga

SEQ ID NO: 866 - DNA, 17 bp, Homo sapiens
tgaaaaaaggcgaggag

SEQ ID NO: 867 - DNA, 17 bp, Homo sapiens
gaaaaaaggcgaggagg

SEQ ID NO: 868 - DNA, 17 bp, Homo sapiens
aaaaaaggcgaggaggg

SEQ ID NO: 869 - DNA, 17 bp, Homo sapiens
aaaaaggcgaggagggt

SEQ ID NO: 870 - DNA, 17 bp, Homo sapiens
aaaaggcgaggagggtc

SEQ ID NO: 871 - DNA, 17 bp, Homo sapiens
aaaggcgaggagggtca

SEQ ID NO: 872 - DNA, 17 bp, Homo sapiens
aaggcgaggagggtcaa

SEQ ID NO: 873 - DNA, 17 bp, Homo sapiens
aggcgaggagggtcaaa

SEQ ID NO: 874 - DNA, 17 bp, Homo sapiens
ggcgaggagggtcaaag

SEQ ID NO: 875 - DNA, 17 bp, Homo sapiens
gcgaggagggtcaaagc

SEQ ID NO: 876 - DNA, 17 bp, Homo sapiens
cgaggagggtcaaagca

SEQ ID NO: 877 - DNA, 17 bp, Homo sapiens
gaggagggtcaaagcat

SEQ ID NO: 878 - DNA, 17 bp, Homo sapiens
aggagggtcaaagcata

SEQ ID NO: 879 - DNA, 17 bp, Homo sapiens
ggagggtcaaagcatag

SEQ ID NO: 880 - DNA, 17 bp, Homo sapiens
gagggtcaaagcatagt

SEQ ID NO: 881 - DNA, 17 bp, Homo sapiens
agggtcaaagcatagtg

SEQ ID NO: 882 - DNA, 17 bp, Homo sapiens
gggtcaaagcatagtgg

SEQ ID NO: 883 - DNA, 17 bp, Homo sapiens
ggtcaaagcatagtggg

SEQ ID NO: 884 - DNA, 17 bp, Homo sapiens
gtcaaagcatagtgggg

SEQ ID NO: 885 - DNA, 17 bp, Homo sapiens
tcaaagcatagtgggga

SEQ ID NO: 886 - DNA, 17 bp, Homo sapiens
caaagcatagtggggaa

SEQ ID NO: 887 - DNA, 17 bp, Homo sapiens
aaagcatagtggggaag

SEQ ID NO: 888 - DNA, 17 bp, Homo sapiens
aagcatagtggggaagg

SEQ ID NO: 889 - DNA, 17 bp, Homo sapiens
agcatagtggggaaggg

SEQ ID NO: 890 - DNA, 17 bp, Homo sapiens
gcatagtggggaagggg

SEQ ID NO: 891 - DNA, 17 bp, Homo sapiens
catagtggggaaggggc

SEQ ID NO: 892 - DNA, 17 bp, Homo sapiens
atagtggggaaggggct

SEQ ID NO: 893 - DNA, 17 bp, Homo sapiens
tagtggggaaggggctt

SEQ ID NO: 894 - DNA, 17 bp, Homo sapiens
agtggggaaggggcttg

SEQ ID NO: 895 - DNA, 17 bp, Homo sapiens
gtggggaaggggcttgg

SEQ ID NO: 896 - DNA, 17 bp, Homo sapiens
tggggaaggggcttggg

SEQ ID NO: 897 - DNA, 17 bp, Homo sapiens
ggggaaggggcttggga

SEQ ID NO: 898 - DNA, 17 bp, Homo sapiens
gggaaggggcttgggac

SEQ ID NO: 899 - DNA, 17 bp, Homo sapiens
ggaaggggcttgggacc

SEQ ID NO: 900 - DNA, 17 bp, Homo sapiens
gaaggggcttgggaccc

SEQ ID NO: 901 - DNA, 17 bp, Homo sapiens
aaggggcttgggacccc

SEQ ID NO: 902 - DNA, 17 bp, Homo sapiens
aggggcttgggaccccc

SEQ ID NO: 903 - DNA, 17 bp, Homo sapiens
ggggcttgggaccccca

SEQ ID NO: 904 - DNA, 17 bp, Homo sapiens
gggcttgggacccccaa

SEQ ID NO: 905 - DNA, 17 bp, Homo sapiens
ggcttgggacccccaag

SEQ ID NO: 906 - DNA, 17 bp, Homo sapiens
gcttgggacccccaaga

SEQ ID NO: 907 - DNA, 17 bp, Homo sapiens
cttgggacccccaagac

SEQ ID NO: 908 - DNA, 17 bp, Homo sapiens
ttgggacccccaagacc

SEQ ID NO: 909 - DNA, 17 bp, Homo sapiens
tgggacccccaagacca

SEQ ID NO: 910 - DNA, 17 bp, Homo sapiens
gggacccccaagaccac

SEQ ID NO: 911 - DNA, 17 bp, Homo sapiens
ggacccccaagaccaca

SEQ ID NO: 912 - DNA, 17 bp, Homo sapiens
gacccccaagaccacag

SEQ ID NO: 913 - DNA, 17 bp, Homo sapiens
acccccaagaccacaga

SEQ ID NO: 914 - DNA, 17 bp, Homo sapiens
cccccaagaccacagag

SEQ ID NO: 915 - DNA, 17 bp, Homo sapiens
ccccaagaccacagagc

SEQ ID NO: 916 - DNA, 17 bp, Homo sapiens
cccaagaccacagagct

SEQ ID NO: 917 - DNA, 17 bp, Homo sapiens
ccaagaccacagagctg

SEQ ID NO: 918 - DNA, 17 bp, Homo sapiens
caagaccacagagctga

SEQ ID NO: 919 - DNA, 17 bp, Homo sapiens
aagaccacagagctgaa

SEQ ID NO: 920 - DNA, 17 bp, Homo sapiens
agaccacagagctgaaa

SEQ ID NO: 921 - DNA, 17 bp, Homo sapiens
gaccacagagctgaaag

SEQ ID NO: 922 - DNA, 17 bp, Homo sapiens
accacagagctgaaaga

SEQ ID NO: 923 - DNA, 17 bp, Homo sapiens
ccacagagctgaaagag

SEQ ID NO: 924 - DNA, 17 bp, Homo sapiens
cacagagctgaaagagg

SEQ ID NO: 925 - DNA, 17 bp, Homo sapiens
acagagctgaaagaggc

SEQ ID NO: 926 - DNA, 17 bp, Homo sapiens
cagagctgaaagaggct

SEQ ID NO: 927 - DNA, 17 bp, Homo sapiens
agagctgaaagaggctg

SEQ ID NO: 928 - DNA, 17 bp, Homo sapiens
gagctgaaagaggctga

SEQ ID NO: 929 - DNA, 17 bp, Homo sapiens
agctgaaagaggctgag

SEQ ID NO: 930 - DNA, 17 bp, Homo sapiens
gctgaaagaggctgagc

SEQ ID NO: 931 - DNA, 17 bp, Homo sapiens
ctgaaagaggctgagcc

SEQ ID NO: 932 - DNA, 17 bp, Homo sapiens
tgaaagaggctgagccc

SEQ ID NO: 933 - DNA, 17 bp, Homo sapiens
gaaagaggctgagcccc

SEQ ID NO: 934 - DNA, 17 bp, Homo sapiens
aaagaggctgagcccca

SEQ ID NO: 935 - DNA, 17 bp, Homo sapiens
aagaggctgagccccag

SEQ ID NO: 936 - DNA, 17 bp, Homo sapiens
agaggctgagccccagg

SEQ ID NO: 937 - DNA, 17 bp, Homo sapiens
gaggctgagccccaggg

SEQ ID NO: 938 - DNA, 17 bp, Homo sapiens
aggctgagccccagggc

SEQ ID NO: 939 - DNA, 17 bp, Homo sapiens
ggctgagccccagggca

SEQ ID NO: 940 - DNA, 17 bp, Homo sapiens
gctgagccccagggcaa

SEQ ID NO: 941 - DNA, 17 bp, Homo sapiens
ctgagccccagggcaaa

SEQ ID NO: 942 - DNA, 17 bp, Homo sapiens
tgagccccagggcaaag

SEQ ID NO: 943 - DNA, 17 bp, Homo sapiens
gagccccagggcaaaga

SEQ ID NO: 944 - DNA, 17 bp, Homo sapiens
agccccagggcaaagac

SEQ ID NO: 945 - DNA, 17 bp, Homo sapiens
gccccagggcaaagaca

SEQ ID NO: 946 - DNA, 17 bp, Homo sapiens
ccccagggcaaagacag

SEQ ID NO: 947 - DNA, 17 bp, Homo sapiens
cccagggcaaagacagg

SEQ ID NO: 948 - DNA, 17 bp, Homo sapiens
ccagggcaaagacaggc

SEQ ID NO: 949 - DNA, 17 bp, Homo sapiens
cagggcaaagacaggca

SEQ ID NO: 950 - DNA, 17 bp, Homo sapiens
agggcaaagacaggcag

SEQ ID NO: 951 - DNA, 17 bp, Homo sapiens
gggcaaagacaggcagg

SEQ ID NO: 952 - DNA, 17 bp, Homo sapiens
ggcaaagacaggcaggg

SEQ ID NO: 953 - DNA, 17 bp, Homo sapiens
gcaaagacaggcagggg

SEQ ID NO: 954 - DNA, 17 bp, Homo sapiens
caaagacaggcagggga

SEQ ID NO: 955 - DNA, 17 bp, Homo sapiens
aaagacaggcaggggac

SEQ ID NO: 956 - DNA, 17 bp, Homo sapiens
aagacaggcaggggacc

SEQ ID NO: 957 - DNA, 17 bp, Homo sapiens
agacaggcaggggacca

SEQ ID NO: 958 - DNA, 17 bp, Homo sapiens
gacaggcaggggaccag

SEQ ID NO: 959 - DNA, 17 bp, Homo sapiens
acaggcaggggaccagg

SEQ ID NO: 960 - DNA, 17 bp, Homo sapiens
caggcaggggaccaggc

SEQ ID NO: 961 - DNA, 17 bp, Homo sapiens
aggcaggggaccaggcc

SEQ ID NO: 962 - DNA, 17 bp, Homo sapiens
ggcaggggaccaggccc

SEQ ID NO: 963 - DNA, 17 bp, Homo sapiens
gcaggggaccaggcccc

SEQ ID NO: 964 - DNA, 17 bp, Homo sapiens
caggggaccaggcccca

SEQ ID NO: 965 - DNA, 17 bp, Homo sapiens
aggggaccaggccccaa

SEQ ID NO: 966 - DNA, 17 bp, Homo sapiens
ggggaccaggccccaag

SEQ ID NO: 967 - DNA, 17 bp, Homo sapiens
gggaccaggccccaagc

SEQ ID NO: 968 - DNA, 17 bp, Homo sapiens
ggaccaggccccaagcc

SEQ ID NO: 969 - DNA, 17 bp, Homo sapiens
gaccaggccccaagccc

SEQ ID NO: 970 - DNA, 17 bp, Homo sapiens
accaggccccaagccca

SEQ ID NO: 971 - DNA, 17 bp, Homo sapiens
ccaggccccaagcccaa

SEQ ID NO: 972 - DNA, 17 bp, Homo sapiens
caggccccaagcccaag

SEQ ID NO: 973 - DNA, 17 bp, Homo sapiens
aggccccaagcccaagg

SEQ ID NO: 974 - DNA, 17 bp, Homo sapiens
ggccccaagcccaaggg

SEQ ID NO: 975 - DNA, 17 bp, Homo sapiens
gccccaagcccaagggc

SEQ ID NO: 976 - DNA, 17 bp, Homo sapiens
ccccaagcccaagggcc

SEQ ID NO: 977 - DNA, 17 bp, Homo sapiens
cccaagcccaagggccc

SEQ ID NO: 978 - DNA, 17 bp, Homo sapiens
ccaagcccaagggcccg

SEQ ID NO: 979 - DNA, 17 bp, Homo sapiens
caagcccaagggcccgg

SEQ ID NO: 980 - DNA, 17 bp, Homo sapiens
aagcccaagggcccggc

SEQ ID NO: 981 - DNA, 17 bp, Homo sapiens
agcccaagggcccggcg

SEQ ID NO: 982 - DNA, 17 bp, Homo sapiens
gcccaagggcccggcga

SEQ ID NO: 983 - DNA, 17 bp, Homo sapiens
cccaagggcccggcgag

SEQ ID NO: 984 - DNA, 17 bp, Homo sapiens
ccaagggcccggcgagg

SEQ ID NO: 985 - DNA, 17 bp, Homo sapiens
caagggcccggcgaggg

SEQ ID NO: 986 - DNA, 17 bp, Homo sapiens
aagggcccggcgagggg

SEQ ID NO: 987 - DNA, 17 bp, Homo sapiens
agggcccggcgaggggg

SEQ ID NO: 988 - DNA, 17 bp, Homo sapiens
gggcccggcgagggggt

SEQ ID NO: 989 - DNA, 17 bp, Homo sapiens
ggcccggcgagggggtg

SEQ ID NO: 990 - DNA, 17 bp, Homo sapiens
gcccggcgagggggtgc

SEQ ID NO: 991 - DNA, 17 bp, Homo sapiens
cccggcgagggggtgcg

SEQ ID NO: 992 - DNA, 17 bp, Homo sapiens
ccggcgagggggtgcga

SEQ ID NO: 993 - DNA, 17 bp, Homo sapiens
cggcgagggggtgcgac

SEQ ID NO: 994 - DNA, 17 bp, Homo sapiens
ggcgagggggtgcgacc

SEQ ID NO: 995 - DNA, 17 bp, Homo sapiens
gcgagggggtgcgacca

SEQ ID NO: 996 - DNA, 17 bp, Homo sapiens
cgagggggtgcgaccag

SEQ ID NO: 997 - DNA, 17 bp, Homo sapiens
gagggggtgcgaccagg

SEQ ID NO: 998 - DNA, 17 bp, Homo sapiens
agggggtgcgaccaggg

SEQ ID NO: 999 - DNA, 17 bp, Homo sapiens
gggggtgcgaccaggga

SEQ ID NO: 1000 - DNA, 17 bp, Homo sapiens
ggggtgcgaccagggaa

SEQ ID NO: 1001 - DNA, 17 bp, Homo sapiens
gggtgcgaccagggaaa

SEQ ID NO: 1002 - DNA, 17 bp, Homo sapiens
ggtgcgaccagggaaag

SEQ ID NO: 1003 - DNA, 17 bp, Homo sapiens
gtgcgaccagggaaagc

SEQ ID NO: 1004 - DNA, 17 bp, Homo sapiens
tgcgaccagggaaagca

SEQ ID NO: 1005 - DNA, 17 bp, Homo sapiens
gcgaccagggaaagcag

SEQ ID NO: 1006 - DNA, 17 bp, Homo sapiens
cgaccagggaaagcaga

SEQ ID NO: 1007 - DNA, 17 bp, Homo sapiens
gaccagggaaagcagag

SEQ ID NO: 1008 - DNA, 17 bp, Homo sapiens
accagggaaagcagaga

SEQ ID NO: 1009 - DNA, 17 bp, Homo sapiens
ccagggaaagcagagaa

SEQ ID NO: 1010 - DNA, 17 bp, Homo sapiens
cagggaaagcagagaag

SEQ ID NO: 1011 - DNA, 17 bp, Homo sapiens
agggaaagcagagaagg

SEQ ID NO: 1012 - DNA, 17 bp, Homo sapiens
gggaaagcagagaagga

SEQ ID NO: 1013 - DNA, 17 bp, Homo sapiens
ggaaagcagagaaggag

SEQ ID NO: 1014 - DNA, 17 bp, Homo sapiens
gaaagcagagaaggagg

SEQ ID NO: 1015 - DNA, 17 bp, Homo sapiens
aaagcagagaaggaggg

SEQ ID NO: 1016 - DNA, 17 bp, Homo sapiens
aagcagagaaggaggga

SEQ ID NO: 1017 - DNA, 17 bp, Homo sapiens
agcagagaaggagggag

SEQ ID NO: 1018 - DNA, 17 bp, Homo sapiens
gcagagaaggagggagc

SEQ ID NO: 1019 - DNA, 17 bp, Homo sapiens
cagagaaggagggagca

SEQ ID NO: 1020 - DNA, 17 bp, Homo sapiens
agagaaggagggagcag

SEQ ID NO: 1021 - DNA, 17 bp, Homo sapiens
gagaaggagggagcaga

SEQ ID NO: 1022 - DNA, 17 bp, Homo sapiens
agaaggagggagcagag

SEQ ID NO: 1023 - DNA, 17 bp, Homo sapiens
gaaggagggagcagagc

SEQ ID NO: 1024 - DNA, 17 bp, Homo sapiens
aaggagggagcagagcc

SEQ ID NO: 1025 - DNA, 17 bp, Homo sapiens
aggagggagcagagccc

SEQ ID NO: 1026 - DNA, 17 bp, Homo sapiens
ggagggagcagagccca

SEQ ID NO: 1027 - DNA, 17 bp, Homo sapiens
gagggagcagagcccac

SEQ ID NO: 1028 - DNA, 17 bp, Homo sapiens
agggagcagagcccaca

SEQ ID NO: 1029 - DNA, 17 bp, Homo sapiens
gggagcagagcccacaa

SEQ ID NO: 1030 - DNA, 17 bp, Homo sapiens
ggagcagagcccacaaa

SEQ ID NO: 1031 - DNA, 17 bp, Homo sapiens
gagcagagcccacaaac

SEQ ID NO: 1032 - DNA, 17 bp, Homo sapiens
agcagagcccacaaaca

SEQ ID NO: 1033 - DNA, 17 bp, Homo sapiens
gcagagcccacaaacac

SEQ ID NO: 1034 - DNA, 17 bp, Homo sapiens
cagagcccacaaacacg

SEQ ID NO: 1035 - DNA, 17 bp, Homo sapiens
agagcccacaaacacgg

SEQ ID NO: 1036 - DNA, 17 bp, Homo sapiens
gagcccacaaacacggt

SEQ ID NO: 1037 - DNA, 17 bp, Homo sapiens
agcccacaaacacggtg

SEQ ID NO: 1038 - DNA, 17 bp, Homo sapiens
gcccacaaacacggtgg

SEQ ID NO: 1039 - DNA, 17 bp, Homo sapiens
cccacaaacacggtgga

SEQ ID NO: 1040 - DNA, 17 bp, Homo sapiens
ccacaaacacggtggaa

SEQ ID NO: 1041 - DNA, 17 bp, Homo sapiens
cacaaacacggtggaaa

SEQ ID NO: 1042 - DNA, 17 bp, Homo sapiens
acaaacacggtggaaaa

SEQ ID NO: 1043 - DNA, 17 bp, Homo sapiens
caaacacggtggaaaag

SEQ ID NO: 1044 - DNA, 17 bp, Homo sapiens
aaacacggtggaaaagg

SEQ ID NO: 1045 - DNA, 17 bp, Homo sapiens
aacacggtggaaaaggg

SEQ ID NO: 1046 - DNA, 17 bp, Homo sapiens
acacggtggaaaagggg

SEQ ID NO: 1047 - DNA, 17 bp, Homo sapiens
cacggtggaaaagggga

SEQ ID NO: 1048 - DNA, 17 bp, Homo sapiens
acggtggaaaaggggaa

SEQ ID NO: 1049 - DNA, 17 bp, Homo sapiens
cggtggaaaaggggaat

SEQ ID NO: 1050 - DNA, 17 bp, Homo sapiens
ggtggaaaaggggaatg

SEQ ID NO: 1051 - DNA, 17 bp, Homo sapiens
gtggaaaaggggaatgt

SEQ ID NO: 1052 - DNA, 17 bp, Homo sapiens
tggaaaaggggaatgtc

SEQ ID NO: 1053 - DNA, 17 bp, Homo sapiens
ggaaaaggggaatgtct

SEQ ID NO: 1054 - DNA, 17 bp, Homo sapiens
gaaaaggggaatgtctc

SEQ ID NO: 1055 - DNA, 17 bp, Homo sapiens
aaaaggggaatgtctct

SEQ ID NO: 1056 - DNA, 17 bp, Homo sapiens
aaaggggaatgtctcta

SEQ ID NO: 1057 - DNA, 17 bp, Homo sapiens
aaggggaatgtctctaa

SEQ ID NO: 1058 - DNA, 17 bp, Homo sapiens
aggggaatgtctctaag

SEQ ID NO: 1059 - DNA, 17 bp, Homo sapiens
ggggaatgtctctaagg

SEQ ID NO: 1060 - DNA, 17 bp, Homo sapiens
gggaatgtctctaagga

SEQ ID NO: 1061 - DNA, 17 bp, Homo sapiens
ggaatgtctctaaggac

SEQ ID NO: 1062 - DNA, 17 bp, Homo sapiens
gaatgtctctaaggacg

SEQ ID NO: 1063 - DNA, 17 bp, Homo sapiens
aatgtctctaaggacgt

SEQ ID NO: 1064 - DNA, 17 bp, Homo sapiens
atgtctctaaggacgta

SEQ ID NO: 1065 - DNA, 17 bp, Homo sapiens
tgtctctaaggacgtag

SEQ ID NO: 1066 - DNA, 17 bp, Homo sapiens
gtctctaaggacgtagg

SEQ ID NO: 1067 - DNA, 17 bp, Homo sapiens
tctctaaggacgtaggg

SEQ ID NO: 1068 - DNA, 17 bp, Homo sapiens
ctctaaggacgtaggga

SEQ ID NO: 1069 - DNA, 17 bp, Homo sapiens
tctaaggacgtagggag

SEQ ID NO: 1070 - DNA, 17 bp, Homo sapiens
ctaaggacgtagggagt

SEQ ID NO: 1071 - DNA, 17 bp, Homo sapiens
taaggacgtagggagtg

SEQ ID NO: 1072 - DNA, 17 bp, Homo sapiens
aaggacgtagggagtga

SEQ ID NO: 1073 - DNA, 17 bp, Homo sapiens
aggacgtagggagtgaa

SEQ ID NO: 1074 - DNA, 17 bp, Homo sapiens
ggacgtagggagtgaag

SEQ ID NO: 1075 - DNA, 17 bp, Homo sapiens
gacgtagggagtgaagg

SEQ ID NO: 1076 - DNA, 17 bp, Homo sapiens
acgtagggagtgaaggg

SEQ ID NO: 1077 - DNA, 17 bp, Homo sapiens
cgtagggagtgaaggga

SEQ ID NO: 1078 - DNA, 17 bp, Homo sapiens
gtagggagtgaagggaa

SEQ ID NO: 1079 - DNA, 17 bp, Homo sapiens
tagggagtgaagggaag

SEQ ID NO: 1080 - DNA, 17 bp, Homo sapiens
agggagtgaagggaagc

SEQ ID NO: 1081 - DNA, 17 bp, Homo sapiens
gggagtgaagggaagca

SEQ ID NO: 1082 - DNA, 17 bp, Homo sapiens
ggagtgaagggaagcac

SEQ ID NO: 1083 - DNA, 17 bp, Homo sapiens
gagtgaagggaagcacg

SEQ ID NO: 1084 - DNA, 17 bp, Homo sapiens
agtgaagggaagcacgt

SEQ ID NO: 1085 - DNA, 17 bp, Homo sapiens
gtgaagggaagcacgta

SEQ ID NO: 1086 - DNA, 17 bp, Homo sapiens
tgaagggaagcacgtaa

SEQ ID NO: 1087 - DNA, 17 bp, Homo sapiens
gaagggaagcacgtaag

SEQ ID NO: 1088 - DNA, 17 bp, Homo sapiens
aagggaagcacgtaagg

SEQ ID NO: 1089 - DNA, 17 bp, Homo sapiens
agggaagcacgtaaggc

SEQ ID NO: 1090 - DNA, 17 bp, Homo sapiens
gggaagcacgtaaggcc

SEQ ID NO: 1091 - DNA, 17 bp, Homo sapiens
ggaagcacgtaaggccc

SEQ ID NO: 1092 - DNA, 17 bp, Homo sapiens
gaagcacgtaaggcccc

SEQ ID NO: 1093 - DNA, 17 bp, Homo sapiens
aagcacgtaaggcccca

SEQ ID NO: 1094 - DNA, 17 bp, Homo sapiens
agcacgtaaggccccaa

SEQ ID NO: 1095 - DNA, 17 bp, Homo sapiens
gcacgtaaggccccaaa

SEQ ID NO: 1096 - DNA, 17 bp, Homo sapiens
cacgtaaggccccaaat

SEQ ID NO: 1097 - DNA, 17 bp, Homo sapiens
acgtaaggccccaaatc

SEQ ID NO: 1098 - DNA, 17 bp, Homo sapiens
cgtaaggccccaaatcc

SEQ ID NO: 1099 - DNA, 17 bp, Homo sapiens
gtaaggccccaaatccc

SEQ ID NO: 1100 - DNA, 17 bp, Homo sapiens
taaggccccaaatccct

SEQ ID NO: 1101 - DNA, 17 bp, Homo sapiens
aaggccccaaatccctg

SEQ ID NO: 1102 - DNA, 17 bp, Homo sapiens
aggccccaaatccctgg

SEQ ID NO: 1103 - DNA, 17 bp, Homo sapiens
ggccccaaatccctggg

SEQ ID NO: 1104 - DNA, 17 bp, Homo sapiens
gccccaaatccctggga

SEQ ID NO: 1105 - DNA, 17 bp, Homo sapiens
ccccaaatccctgggag

SEQ ID NO: 1106 - DNA, 17 bp, Homo sapiens
cccaaatccctgggaga

SEQ ID NO: 1107 - DNA, 17 bp, Homo sapiens
ccaaatccctgggagaa

SEQ ID NO: 1108 - DNA, 17 bp, Homo sapiens
caaatccctgggagaaa

SEQ ID NO: 1109 - DNA, 17 bp, Homo sapiens
aaatccctgggagaaag

SEQ ID NO: 1110 - DNA, 17 bp, Homo sapiens
aatccctgggagaaagt

SEQ ID NO: 1111 - DNA, 17 bp, Homo sapiens
atccctgggagaaagtg

SEQ ID NO: 1112 - DNA, 17 bp, Homo sapiens
tccctgggagaaagtgg

SEQ ID NO: 1113 - DNA, 17 bp, Homo sapiens
ccctgggagaaagtggg

SEQ ID NO: 1114 - DNA, 17 bp, Homo sapiens
cctgggagaaagtgggg

SEQ ID NO: 1115 - DNA, 17 bp, Homo sapiens
ctgggagaaagtgggga

SEQ ID NO: 1116 - DNA, 17 bp, Homo sapiens
tgggagaaagtggggag

SEQ ID NO: 1117 - DNA, 17 bp, Homo sapiens
gggagaaagtggggagg

SEQ ID NO: 1118 - DNA, 17 bp, Homo sapiens
ggagaaagtggggaggt

SEQ ID NO: 1119 - DNA, 17 bp, Homo sapiens
gagaaagtggggaggtt

SEQ ID NO: 1120 - DNA, 17 bp, Homo sapiens
agaaagtggggaggttt

SEQ ID NO: 1121 - DNA, 17 bp, Homo sapiens
gaaagtggggaggtttc

SEQ ID NO: 1122 - DNA, 17 bp, Homo sapiens
aaagtggggaggtttcc

SEQ ID NO: 1123 - DNA, 17 bp, Homo sapiens
aagtggggaggtttcct

SEQ ID NO: 1124 - DNA, 17 bp, Homo sapiens
agtggggaggtttcctg

SEQ ID NO: 1125 - DNA, 17 bp, Homo sapiens
gtggggaggtttcctgg

SEQ ID NO: 1126 - DNA, 17 bp, Homo sapiens
tggggaggtttcctggg

SEQ ID NO: 1127 - DNA, 17 bp, Homo sapiens
ggggaggtttcctggga

SEQ ID NO: 1128 - DNA, 17 bp, Homo sapiens
gggaggtttcctgggaa

SEQ ID NO: 1129 - DNA, 17 bp, Homo sapiens
ggaggtttcctgggaag

SEQ ID NO: 1130 - DNA, 17 bp, Homo sapiens
gaggtttcctgggaaga

SEQ ID NO: 1131 - DNA, 17 bp, Homo sapiens
aggtttcctgggaagaa

SEQ ID NO: 1132 - DNA, 17 bp, Homo sapiens
ggtttcctgggaagaag

SEQ ID NO: 1133 - DNA, 17 bp, Homo sapiens
gtttcctgggaagaagg

SEQ ID NO: 1134 - DNA, 17 bp, Homo sapiens
tttcctgggaagaagga

SEQ ID NO: 1135 - DNA, 17 bp, Homo sapiens
ttcctgggaagaaggag

SEQ ID NO: 1136 - DNA, 17 bp, Homo sapiens
tcctgggaagaaggagt

SEQ ID NO: 1137 - DNA, 17 bp, Homo sapiens
cctgggaagaaggagta

SEQ ID NO: 1138 - DNA, 17 bp, Homo sapiens
ctgggaagaaggagtaa

SEQ ID NO: 1139 - DNA, 17 bp, Homo sapiens
tgggaagaaggagtaag

SEQ ID NO: 1140 - DNA, 17 bp, Homo sapiens
gggaagaaggagtaagt

SEQ ID NO: 1141 - DNA, 17 bp, Homo sapiens
ggaagaaggagtaagtg

SEQ ID NO: 1142 - DNA, 17 bp, Homo sapiens
gaagaaggagtaagtgg

SEQ ID NO: 1143 - DNA, 17 bp, Homo sapiens
aagaaggagtaagtggg

SEQ ID NO: 1144 - DNA, 17 bp, Homo sapiens
agaaggagtaagtggga

SEQ ID NO: 1145 - DNA, 17 bp, Homo sapiens
gaaggagtaagtgggac

SEQ ID NO: 1146 - DNA, 17 bp, Homo sapiens
aaggagtaagtgggacg

SEQ ID NO: 1147 - DNA, 17 bp, Homo sapiens
aggagtaagtgggacgg

SEQ ID NO: 1148 - DNA, 17 bp, Homo sapiens
ggagtaagtgggacggt

SEQ ID NO: 1149 - DNA, 17 bp, Homo sapiens
gagtaagtgggacggtc

SEQ ID NO: 1150 - DNA, 17 bp, Homo sapiens
agtaagtgggacggtcc

SEQ ID NO: 1151 - DNA, 17 bp, Homo sapiens
gtaagtgggacggtccc

SEQ ID NO: 1152 - DNA, 17 bp, Homo sapiens
taagtgggacggtcccc

SEQ ID NO: 1153 - DNA, 17 bp, Homo sapiens
aagtgggacggtcccca

SEQ ID NO: 1154 - DNA, 17 bp, Homo sapiens
agtgggacggtccccag

SEQ ID NO: 1155 - DNA, 17 bp, Homo sapiens
gtgggacggtccccaga

SEQ ID NO: 1156 - DNA, 17 bp, Homo sapiens
tgggacggtccccagaa

SEQ ID NO: 1157 - DNA, 17 bp, Homo sapiens
gggacggtccccagaat

SEQ ID NO: 1158 - DNA, 17 bp, Homo sapiens
ggacggtccccagaata

SEQ ID NO: 1159 - DNA, 17 bp, Homo sapiens
gacggtccccagaataa

SEQ ID NO: 1160 - DNA, 17 bp, Homo sapiens
acggtccccagaataag

SEQ ID NO: 1161 - DNA, 17 bp, Homo sapiens
cggtccccagaataaga

SEQ ID NO: 1162 - DNA, 17 bp, Homo sapiens
ggtccccagaataagaa

SEQ ID NO: 1163 - DNA, 17 bp, Homo sapiens
gtccccagaataagaag

SEQ ID NO: 1164 - DNA, 17 bp, Homo sapiens
tccccagaataagaagg

SEQ ID NO: 1165 - DNA, 17 bp, Homo sapiens
ccccagaataagaagga

SEQ ID NO: 1166 - DNA, 17 bp, Homo sapiens
cccagaataagaaggac

SEQ ID NO: 1167 - DNA, 17 bp, Homo sapiens
ccagaataagaaggaca

SEQ ID NO: 1168 - DNA, 17 bp, Homo sapiens
cagaataagaaggacaa

SEQ ID NO: 1169 - DNA, 17 bp, Homo sapiens
agaataagaaggacaaa

SEQ ID NO: 1170 - DNA, 17 bp, Homo sapiens
gaataagaaggacaaag

SEQ ID NO: 1171 - DNA, 17 bp, Homo sapiens
aataagaaggacaaaga

SEQ ID NO: 1172 - DNA, 17 bp, Homo sapiens
ataagaaggacaaagaa

SEQ ID NO: 1173 - DNA, 17 bp, Homo sapiens
taagaaggacaaagaag

SEQ ID NO: 1174 - DNA, 17 bp, Homo sapiens
aagaaggacaaagaagg

SEQ ID NO: 1175 - DNA, 17 bp, Homo sapiens
agaaggacaaagaaggg

SEQ ID NO: 1176 - DNA, 17 bp, Homo sapiens
gaaggacaaagaagggg

SEQ ID NO: 1177 - DNA, 17 bp, Homo sapiens
aaggacaaagaaggggt

SEQ ID NO: 1178 - DNA, 17 bp, Homo sapiens
aggacaaagaaggggtg

SEQ ID NO: 1179 - DNA, 17 bp, Homo sapiens
ggacaaagaaggggtgc

SEQ ID NO: 1180 - DNA, 17 bp, Homo sapiens
gacaaagaaggggtgct

SEQ ID NO: 1181 - DNA, 17 bp, Homo sapiens
acaaagaaggggtgctc

SEQ ID NO: 1182 - DNA, 17 bp, Homo sapiens
caaagaaggggtgctct

SEQ ID NO: 1183 - DNA, 17 bp, Homo sapiens
aaagaaggggtgctctt

SEQ ID NO: 1184 - DNA, 17 bp, Homo sapiens
aagaaggggtgctctta

SEQ ID NO: 1185 - DNA, 17 bp, Homo sapiens
agaaggggtgctcttaa

SEQ ID NO: 1186 - DNA, 17 bp, Homo sapiens
gaaggggtgctcttaag

SEQ ID NO: 1187 - DNA, 17 bp, Homo sapiens
aaggggtgctcttaagt

SEQ ID NO: 1188 - DNA, 17 bp, Homo sapiens
aggggtgctcttaagta

SEQ ID NO: 1189 - DNA, 17 bp, Homo sapiens
ggggtgctcttaagtaa

SEQ ID NO: 1190 - DNA, 17 bp, Homo sapiens
gggtgctcttaagtaag

SEQ ID NO: 1191 - DNA, 17 bp, Homo sapiens
ggtgctcttaagtaagg

SEQ ID NO: 1192 - DNA, 17 bp, Homo sapiens
gtgctcttaagtaaggc

SEQ ID NO: 1193 - DNA, 17 bp, Homo sapiens
tgctcttaagtaaggca

SEQ ID NO: 1194 - DNA, 17 bp, Homo sapiens
gctcttaagtaaggcag

SEQ ID NO: 1195 - DNA, 17 bp, Homo sapiens
ctcttaagtaaggcaga

SEQ ID NO: 1196 - DNA, 17 bp, Homo sapiens
tcttaagtaaggcagag

SEQ ID NO: 1197 - DNA, 17 bp, Homo sapiens
cttaagtaaggcagaga

SEQ ID NO: 1198 - DNA, 17 bp, Homo sapiens
ttaagtaaggcagagaa

SEQ ID NO: 1199 - DNA, 17 bp, Homo sapiens
taagtaaggcagagaag

SEQ ID NO: 1200 - DNA, 17 bp, Homo sapiens
aagtaaggcagagaaga

SEQ ID NO: 1201 - DNA, 17 bp, Homo sapiens
agtaaggcagagaagac

SEQ ID NO: 1202 - DNA, 17 bp, Homo sapiens
gtaaggcagagaagaca

SEQ ID NO: 1203 - DNA, 17 bp, Homo sapiens
taaggcagagaagacag

SEQ ID NO: 1204 - DNA, 17 bp, Homo sapiens
aaggcagagaagacagg

SEQ ID NO: 1205 - DNA, 17 bp, Homo sapiens
aggcagagaagacaggt

SEQ ID NO: 1206 - DNA, 17 bp, Homo sapiens
ggcagagaagacaggtg

SEQ ID NO: 1207 - DNA, 17 bp, Homo sapiens
gcagagaagacaggtga

SEQ ID NO: 1208 - DNA, 17 bp, Homo sapiens
cagagaagacaggtgag

SEQ ID NO: 1209 - DNA, 17 bp, Homo sapiens
agagaagacaggtgagc

SEQ ID NO: 1210 - DNA, 17 bp, Homo sapiens
gagaagacaggtgagcc

SEQ ID NO: 1211 - DNA, 17 bp, Homo sapiens
agaagacaggtgagcct

SEQ ID NO: 1212 - DNA, 17 bp, Homo sapiens
gaagacaggtgagcctc

SEQ ID NO: 1213 - DNA, 17 bp, Homo sapiens
aagacaggtgagcctca

SEQ ID NO: 1214 - DNA, 17 bp, Homo sapiens
agacaggtgagcctcag

SEQ ID NO: 1215 - DNA, 17 bp, Homo sapiens
gacaggtgagcctcaga

SEQ ID NO: 1216 - DNA, 17 bp, Homo sapiens
acaggtgagcctcagac

SEQ ID NO: 1217 - DNA, 17 bp, Homo sapiens
caggtgagcctcagacc

SEQ ID NO: 1218 - DNA, 17 bp, Homo sapiens
aggtgagcctcagaccc

SEQ ID NO: 1219 - DNA, 17 bp, Homo sapiens
ggtgagcctcagaccca

SEQ ID NO: 1220 - DNA, 17 bp, Homo sapiens
gtgagcctcagacccag

SEQ ID NO: 1221 - DNA, 17 bp, Homo sapiens
tgagcctcagacccaga

SEQ ID NO: 1222 - DNA, 17 bp, Homo sapiens
gagcctcagacccagat

SEQ ID NO: 1223 - DNA, 17 bp, Homo sapiens
agcctcagacccagatg

SEQ ID NO: 1224 - DNA, 17 bp, Homo sapiens
gcctcagacccagatgg

SEQ ID NO: 1225 - DNA, 17 bp, Homo sapiens
cctcagacccagatgga

SEQ ID NO: 1226 - DNA, 17 bp, Homo sapiens
ctcagacccagatggag

SEQ ID NO: 1227 - DNA, 17 bp, Homo sapiens
tcagacccagatggaga

SEQ ID NO: 1228 - DNA, 17 bp, Homo sapiens
cagacccagatggagaa

SEQ ID NO: 1229 - DNA, 17 bp, Homo sapiens
agacccagatggagaag

SEQ ID NO: 1230 - DNA, 17 bp, Homo sapiens
gacccagatggagaaga

SEQ ID NO: 1231 - DNA, 17 bp, Homo sapiens
acccagatggagaagac

SEQ ID NO: 1232 - DNA, 17 bp, Homo sapiens
cccagatggagaagaca

SEQ ID NO: 1233 - DNA, 17 bp, Homo sapiens
ccagatggagaagacaa

SEQ ID NO: 1234 - DNA, 17 bp, Homo sapiens
cagatggagaagacaag

SEQ ID NO: 1235 - DNA, 17 bp, Homo sapiens
agatggagaagacaagc

SEQ ID NO: 1236 - DNA, 17 bp, Homo sapiens
gatggagaagacaagcc

SEQ ID NO: 1237 - DNA, 17 bp, Homo sapiens
atggagaagacaagcca

SEQ ID NO: 1238 - DNA, 17 bp, Homo sapiens
tggagaagacaagccaa

SEQ ID NO: 1239 - DNA, 17 bp, Homo sapiens
ggagaagacaagccaag

SEQ ID NO: 1240 - DNA, 17 bp, Homo sapiens
gagaagacaagccaagt

SEQ ID NO: 1241 - DNA, 17 bp, Homo sapiens
agaagacaagccaagtg

SEQ ID NO: 1242 - DNA, 17 bp, Homo sapiens
gaagacaagccaagtgc

SEQ ID NO: 1243 - DNA, 17 bp, Homo sapiens
aagacaagccaagtgca

SEQ ID NO: 1244 - DNA, 17 bp, Homo sapiens
agacaagccaagtgcag

SEQ ID NO: 1245 - DNA, 17 bp, Homo sapiens
gacaagccaagtgcagg

SEQ ID NO: 1246 - DNA, 17 bp, Homo sapiens
acaagccaagtgcaggg

SEQ ID NO: 1247 - DNA, 17 bp, Homo sapiens
caagccaagtgcagggc

SEQ ID NO: 1248 - DNA, 17 bp, Homo sapiens
aagccaagtgcagggcg

SEQ ID NO: 1249 - DNA, 17 bp, Homo sapiens
agccaagtgcagggcga

SEQ ID NO: 1250 - DNA, 17 bp, Homo sapiens
gccaagtgcagggcgag

SEQ ID NO: 1251 - DNA, 17 bp, Homo sapiens
ccaagtgcagggcgagt

SEQ ID NO: 1252 - DNA, 17 bp, Homo sapiens
caagtgcagggcgagtt

SEQ ID NO: 1253 - DNA, 17 bp, Homo sapiens
aagtgcagggcgagttg

SEQ ID NO: 1254 - DNA, 17 bp, Homo sapiens
agtgcagggcgagttgg

SEQ ID NO: 1255 - DNA, 17 bp, Homo sapiens
gtgcagggcgagttggg

SEQ ID NO: 1256 - DNA, 17 bp, Homo sapiens
tgcagggcgagttgggg

SEQ ID NO: 1257 - DNA, 17 bp, Homo sapiens
gcagggcgagttggggg

SEQ ID NO: 1258 - DNA, 17 bp, Homo sapiens
cagggcgagttggggga

SEQ ID NO: 1259 - DNA, 17 bp, Homo sapiens
agggcgagttgggggac

SEQ ID NO: 1260 - DNA, 17 bp, Homo sapiens
gggcgagttgggggacg

SEQ ID NO: 1261 - DNA, 17 bp, Homo sapiens
ggcgagttgggggacga

SEQ ID NO: 1262 - DNA, 17 bp, Homo sapiens
gcgagttgggggacgat

SEQ ID NO: 1263 - DNA, 17 bp, Homo sapiens
cgagttgggggacgatc

SEQ ID NO: 1264 - DNA, 17 bp, Homo sapiens
gagttgggggacgatct

SEQ ID NO: 1265 - DNA, 17 bp, Homo sapiens
agttgggggacgatctg

SEQ ID NO: 1266 - DNA, 17 bp, Homo sapiens
gttgggggacgatctga

SEQ ID NO: 1267 - DNA, 17 bp, Homo sapiens
ttgggggacgatctgag

SEQ ID NO: 1268 - DNA, 17 bp, Homo sapiens
tgggggacgatctgaga

SEQ ID NO: 1269 - DNA, 17 bp, Homo sapiens
gggggacgatctgagaa

SEQ ID NO: 1270 - DNA, 17 bp, Homo sapiens
ggggacgatctgagaat

SEQ ID NO: 1271 - DNA, 17 bp, Homo sapiens
gggacgatctgagaatg

SEQ ID NO: 1272 - DNA, 17 bp, Homo sapiens
ggacgatctgagaatgg

SEQ ID NO: 1273 - DNA, 17 bp, Homo sapiens
gacgatctgagaatggg

SEQ ID NO: 1274 - DNA, 17 bp, Homo sapiens
acgatctgagaatgggg

SEQ ID NO: 1275 - DNA, 17 bp, Homo sapiens
cgatctgagaatggggg

SEQ ID NO: 1276 - DNA, 17 bp, Homo sapiens
gatctgagaatggggga

SEQ ID NO: 1277 - DNA, 17 bp, Homo sapiens
atctgagaatgggggag

SEQ ID NO: 1278 - DNA, 17 bp, Homo sapiens
tctgagaatgggggaga

SEQ ID NO: 1279 - DNA, 17 bp, Homo sapiens
ctgagaatgggggagaa

SEQ ID NO: 1280 - DNA, 17 bp, Homo sapiens
tgagaatgggggagaaa

SEQ ID NO: 1281 - DNA, 17 bp, Homo sapiens
gagaatgggggagaaag

SEQ ID NO: 1282 - DNA, 17 bp, Homo sapiens
agaatgggggagaaagc

SEQ ID NO: 1283 - DNA, 17 bp, Homo sapiens
gaatgggggagaaagca

SEQ ID NO: 1284 - DNA, 17 bp, Homo sapiens
aatgggggagaaagcag

SEQ ID NO: 1285 - DNA, 17 bp, Homo sapiens
atgggggagaaagcagg

SEQ ID NO: 1286 - DNA, 17 bp, Homo sapiens
tgggggagaaagcaggt

SEQ ID NO: 1287 - DNA, 17 bp, Homo sapiens
gggggagaaagcaggtg

SEQ ID NO: 1288 - DNA, 17 bp, Homo sapiens
ggggagaaagcaggtga

SEQ ID NO: 1289 - DNA, 17 bp, Homo sapiens
gggagaaagcaggtgag

SEQ ID NO: 1290 - DNA, 17 bp, Homo sapiens
ggagaaagcaggtgagc

SEQ ID NO: 1291 - DNA, 17 bp, Homo sapiens
gagaaagcaggtgagct

SEQ ID NO: 1292 - DNA, 17 bp, Homo sapiens
agaaagcaggtgagctt

SEQ ID NO: 1293 - DNA, 17 bp, Homo sapiens
gaaagcaggtgagcttc

SEQ ID NO: 1294 - DNA, 17 bp, Homo sapiens
aaagcaggtgagcttcg

SEQ ID NO: 1295 - DNA, 17 bp, Homo sapiens
aagcaggtgagcttcgg

SEQ ID NO: 1296 - DNA, 17 bp, Homo sapiens
agcaggtgagcttcgga

SEQ ID NO: 1297 - DNA, 17 bp, Homo sapiens
gcaggtgagcttcggag

SEQ ID NO: 1298 - DNA, 17 bp, Homo sapiens
caggtgagcttcggagc

SEQ ID NO: 1299 - DNA, 17 bp, Homo sapiens
aggtgagcttcggagca

SEQ ID NO: 1300 - DNA, 17 bp, Homo sapiens
ggtgagcttcggagcac

SEQ ID NO: 1301 - DNA, 17 bp, Homo sapiens
gtgagcttcggagcacg

SEQ ID NO: 1302 - DNA, 17 bp, Homo sapiens
tgagcttcggagcacga

SEQ ID NO: 1303 - DNA, 17 bp, Homo sapiens
gagcttcggagcacgac

SEQ ID NO: 1304 - DNA, 17 bp, Homo sapiens
agcttcggagcacgact

SEQ ID NO: 1305 - DNA, 17 bp, Homo sapiens
gcttcggagcacgactg

SEQ ID NO: 1306 - DNA, 17 bp, Homo sapiens
cttcggagcacgactgg

SEQ ID NO: 1307 - DNA, 17 bp, Homo sapiens
ttcggagcacgactggg

SEQ ID NO: 1308 - DNA, 17 bp, Homo sapiens
tcggagcacgactggga

SEQ ID NO: 1309 - DNA, 17 bp, Homo sapiens
cggagcacgactgggaa

SEQ ID NO: 1310 - DNA, 17 bp, Homo sapiens
ggagcacgactgggaag

SEQ ID NO: 1311 - DNA, 17 bp, Homo sapiens
gagcacgactgggaagg

SEQ ID NO: 1312 - DNA, 17 bp, Homo sapiens
agcacgactgggaaggc

SEQ ID NO: 1313 - DNA, 17 bp, Homo sapiens
gcacgactgggaaggca

SEQ ID NO: 1314 - DNA, 17 bp, Homo sapiens
cacgactgggaaggcag

SEQ ID NO: 1315 - DNA, 17 bp, Homo sapiens
acgactgggaaggcagg

SEQ ID NO: 1316 - DNA, 17 bp, Homo sapiens
cgactgggaaggcaggt

SEQ ID NO: 1317 - DNA, 17 bp, Homo sapiens
gactgggaaggcaggtg

SEQ ID NO: 1318 - DNA, 17 bp, Homo sapiens
actgggaaggcaggtga

SEQ ID NO: 1319 - DNA, 17 bp, Homo sapiens
ctgggaaggcaggtgag

SEQ ID NO: 1320 - DNA, 17 bp, Homo sapiens
tgggaaggcaggtgagt

SEQ ID NO: 1321 - DNA, 17 bp, Homo sapiens
gggaaggcaggtgagtc

SEQ ID NO: 1322 - DNA, 17 bp, Homo sapiens
ggaaggcaggtgagtcc

SEQ ID NO: 1323 - DNA, 17 bp, Homo sapiens
gaaggcaggtgagtcct

SEQ ID NO: 1324 - DNA, 17 bp, Homo sapiens
aaggcaggtgagtcctg

SEQ ID NO: 1325 - DNA, 17 bp, Homo sapiens
aggcaggtgagtcctgg

SEQ ID NO: 1326 - DNA, 17 bp, Homo sapiens
ggcaggtgagtcctggg

SEQ ID NO: 1327 - DNA, 17 bp, Homo sapiens
gcaggtgagtcctggga

SEQ ID NO: 1328 - DNA, 17 bp, Homo sapiens
caggtgagtcctgggat

SEQ ID NO: 1329 - DNA, 17 bp, Homo sapiens
aggtgagtcctgggata

SEQ ID NO: 1330 - DNA, 17 bp, Homo sapiens
ggtgagtcctgggataa

SEQ ID NO: 1331 - DNA, 17 bp, Homo sapiens
gtgagtcctgggataag

SEQ ID NO: 1332 - DNA, 17 bp, Homo sapiens
tgagtcctgggataaga

SEQ ID NO: 1333 - DNA, 17 bp, Homo sapiens
gagtcctgggataagaa

SEQ ID NO: 1334 - DNA, 17 bp, Homo sapiens
agtcctgggataagaag

SEQ ID NO: 1335 - DNA, 17 bp, Homo sapiens
gtcctgggataagaagg

SEQ ID NO: 1336 - DNA, 17 bp, Homo sapiens
tcctgggataagaagga

SEQ ID NO: 1337 - DNA, 17 bp, Homo sapiens
cctgggataagaaggaa

SEQ ID NO: 1338 - DNA, 17 bp, Homo sapiens
ctgggataagaaggaaa

SEQ ID NO: 1339 - DNA, 17 bp, Homo sapiens
tgggataagaaggaaaa

SEQ ID NO: 1340 - DNA, 17 bp, Homo sapiens
gggataagaaggaaaag

SEQ ID NO: 1341 - DNA, 17 bp, Homo sapiens
ggataagaaggaaaaga

SEQ ID NO: 1342 - DNA, 17 bp, Homo sapiens
gataagaaggaaaagat

SEQ ID NO: 1343 - DNA, 17 bp, Homo sapiens
ataagaaggaaaagatg

SEQ ID NO: 1344 - DNA, 17 bp, Homo sapiens
taagaaggaaaagatgg

SEQ ID NO: 1345 - DNA, 17 bp, Homo sapiens
aagaaggaaaagatggg

SEQ ID NO: 1346 - DNA, 17 bp, Homo sapiens
agaaggaaaagatgggg

SEQ ID NO: 1347 - DNA, 17 bp, Homo sapiens
gaaggaaaagatggggc

SEQ ID NO: 1348 - DNA, 17 bp, Homo sapiens
aaggaaaagatggggca

SEQ ID NO: 1349 - DNA, 17 bp, Homo sapiens
aggaaaagatggggcaa

SEQ ID NO: 1350 - DNA, 17 bp, Homo sapiens
ggaaaagatggggcaac

SEQ ID NO: 1351 - DNA, 17 bp, Homo sapiens
gaaaagatggggcaacc

SEQ ID NO: 1352 - DNA, 17 bp, Homo sapiens
aaaagatggggcaaccc

SEQ ID NO: 1353 - DNA, 17 bp, Homo sapiens
aaagatggggcaacccc

SEQ ID NO: 1354 - DNA, 17 bp, Homo sapiens
aagatggggcaacccca

SEQ ID NO: 1355 - DNA, 17 bp, Homo sapiens
agatggggcaaccccag

SEQ ID NO: 1356 - DNA, 17 bp, Homo sapiens
gatggggcaaccccagg

SEQ ID NO: 1357 - DNA, 17 bp, Homo sapiens
atggggcaaccccaggg

SEQ ID NO: 1358 - DNA, 17 bp, Homo sapiens
tggggcaaccccagggt

SEQ ID NO: 1359 - DNA, 17 bp, Homo sapiens
ggggcaaccccagggta

SEQ ID NO: 1360 - DNA, 17 bp, Homo sapiens
gggcaaccccagggtaa

SEQ ID NO: 1361 - DNA, 17 bp, Homo sapiens
ggcaaccccagggtaag

SEQ ID NO: 1362 - DNA, 17 bp, Homo sapiens
gcaaccccagggtaagt

SEQ ID NO: 1363 - DNA, 17 bp, Homo sapiens
caaccccagggtaagtc

SEQ ID NO: 1364 - DNA, 17 bp, Homo sapiens
aaccccagggtaagtcc

SEQ ID NO: 1365 - DNA, 17 bp, Homo sapiens
accccagggtaagtccg

SEQ ID NO: 1366 - DNA, 17 bp, Homo sapiens
ccccagggtaagtccgg

SEQ ID NO: 1367 - DNA, 17 bp, Homo sapiens
cccagggtaagtccggg

SEQ ID NO: 1368 - DNA, 17 bp, Homo sapiens
ccagggtaagtccggga

SEQ ID NO: 1369 - DNA, 17 bp, Homo sapiens
cagggtaagtccgggaa

SEQ ID NO: 1370 - DNA, 17 bp, Homo sapiens
agggtaagtccgggaac

SEQ ID NO: 1371 - DNA, 17 bp, Homo sapiens
gggtaagtccgggaacg

SEQ ID NO: 1372 - DNA, 17 bp, Homo sapiens
ggtaagtccgggaacgc

SEQ ID NO: 1373 - DNA, 17 bp, Homo sapiens
gtaagtccgggaacgca

SEQ ID NO: 1374 - DNA, 17 bp, Homo sapiens
taagtccgggaacgcag

SEQ ID NO: 1375 - DNA, 17 bp, Homo sapiens
aagtccgggaacgcagg

SEQ ID NO: 1376 - DNA, 17 bp, Homo sapiens
agtccgggaacgcaggt

SEQ ID NO: 1377 - DNA, 17 bp, Homo sapiens
gtccgggaacgcaggtg

SEQ ID NO: 1378 - DNA, 17 bp, Homo sapiens
tccgggaacgcaggtga

SEQ ID NO: 1379 - DNA, 17 bp, Homo sapiens
ccgggaacgcaggtgaa

SEQ ID NO: 1380 - DNA, 17 bp, Homo sapiens
cgggaacgcaggtgaag

SEQ ID NO: 1381 - DNA, 17 bp, Homo sapiens
gggaacgcaggtgaagc

SEQ ID NO: 1382 - DNA, 17 bp, Homo sapiens
ggaacgcaggtgaagct

SEQ ID NO: 1383 - DNA, 17 bp, Homo sapiens
gaacgcaggtgaagctc

SEQ ID NO: 1384 - DNA, 17 bp, Homo sapiens
aacgcaggtgaagctcg

SEQ ID NO: 1385 - DNA, 17 bp, Homo sapiens
acgcaggtgaagctcgg

SEQ ID NO: 1386 - DNA, 17 bp, Homo sapiens
cgcaggtgaagctcgga

SEQ ID NO: 1387 - DNA, 17 bp, Homo sapiens
gcaggtgaagctcggag

SEQ ID NO: 1388 - DNA, 17 bp, Homo sapiens
caggtgaagctcggagt

SEQ ID NO: 1389 - DNA, 17 bp, Homo sapiens
aggtgaagctcggagtc

SEQ ID NO: 1390 - DNA, 17 bp, Homo sapiens
ggtgaagctcggagtca

SEQ ID NO: 1391 - DNA, 17 bp, Homo sapiens
gtgaagctcggagtcag

SEQ ID NO: 1392 - DNA, 17 bp, Homo sapiens
tgaagctcggagtcaga

SEQ ID NO: 1393 - DNA, 17 bp, Homo sapiens
gaagctcggagtcagac

SEQ ID NO: 1394 - DNA, 17 bp, Homo sapiens
aagctcggagtcagaca

SEQ ID NO: 1395 - DNA, 17 bp, Homo sapiens
agctcggagtcagacag

SEQ ID NO: 1396 - DNA, 17 bp, Homo sapiens
gctcggagtcagacaga

SEQ ID NO: 1397 - DNA, 17 bp, Homo sapiens
ctcggagtcagacagag

SEQ ID NO: 1398 - DNA, 17 bp, Homo sapiens
tcggagtcagacagaga

SEQ ID NO: 1399 - DNA, 17 bp, Homo sapiens
cggagtcagacagagaa

SEQ ID NO: 1400 - DNA, 17 bp, Homo sapiens
ggagtcagacagagaag

SEQ ID NO: 1401 - DNA, 17 bp, Homo sapiens
gagtcagacagagaagg

SEQ ID NO: 1402 - DNA, 17 bp, Homo sapiens
agtcagacagagaaggg

SEQ ID NO: 1403 - DNA, 17 bp, Homo sapiens
gtcagacagagaagggc

SEQ ID NO: 1404 - DNA, 17 bp, Homo sapiens
tcagacagagaagggct

SEQ ID NO: 1405 - DNA, 17 bp, Homo sapiens
cagacagagaagggctg

SEQ ID NO: 1406 - DNA, 17 bp, Homo sapiens
agacagagaagggctgt

SEQ ID NO: 1407 - DNA, 17 bp, Homo sapiens
gacagagaagggctgtg

SEQ ID NO: 1408 - DNA, 17 bp, Homo sapiens
acagagaagggctgtga

SEQ ID NO: 1409 - DNA, 17 bp, Homo sapiens
cagagaagggctgtgaa

SEQ ID NO: 1410 - DNA, 17 bp, Homo sapiens
agagaagggctgtgaag

SEQ ID NO: 1411 - DNA, 17 bp, Homo sapiens
gagaagggctgtgaagc

SEQ ID NO: 1412 - DNA, 17 bp, Homo sapiens
agaagggctgtgaagcc

SEQ ID NO: 1413 - DNA, 17 bp, Homo sapiens
gaagggctgtgaagccc

SEQ ID NO: 1414 - DNA, 17 bp, Homo sapiens
aagggctgtgaagcccc

SEQ ID NO: 1415 - DNA, 17 bp, Homo sapiens
agggctgtgaagcccca

SEQ ID NO: 1416 - DNA, 17 bp, Homo sapiens
gggctgtgaagccccaa

SEQ ID NO: 1417 - DNA, 17 bp, Homo sapiens
ggctgtgaagccccaaa

SEQ ID NO: 1418 - DNA, 17 bp, Homo sapiens
gctgtgaagccccaaag

SEQ ID NO: 1419 - DNA, 17 bp, Homo sapiens
ctgtgaagccccaaagg

SEQ ID NO: 1420 - DNA, 17 bp, Homo sapiens
tgtgaagccccaaagga

SEQ ID NO: 1421 - DNA, 17 bp, Homo sapiens
gtgaagccccaaaggag

SEQ ID NO: 1422 - DNA, 17 bp, Homo sapiens
tgaagccccaaaggagg

SEQ ID NO: 1423 - DNA, 17 bp, Homo sapiens
gaagccccaaaggaggt

SEQ ID NO: 1424 - DNA, 17 bp, Homo sapiens
aagccccaaaggaggtg

SEQ ID NO: 1425 - DNA, 17 bp, Homo sapiens
agccccaaaggaggtga

SEQ ID NO: 1426 - DNA, 17 bp, Homo sapiens
gccccaaaggaggtgag

SEQ ID NO: 1427 - DNA, 17 bp, Homo sapiens
ccccaaaggaggtgagc

SEQ ID NO: 1428 - DNA, 17 bp, Homo sapiens
cccaaaggaggtgagca

SEQ ID NO: 1429 - DNA, 17 bp, Homo sapiens
ccaaaggaggtgagcac

SEQ ID NO: 1430 - DNA, 17 bp, Homo sapiens
caaaggaggtgagcaca

SEQ ID NO: 1431 - DNA, 17 bp, Homo sapiens
aaaggaggtgagcacaa

SEQ ID NO: 1432 - DNA, 17 bp, Homo sapiens
aaggaggtgagcacaat

SEQ ID NO: 1433 - DNA, 17 bp, Homo sapiens
aggaggtgagcacaatg

SEQ ID NO: 1434 - DNA, 17 bp, Homo sapiens
ggaggtgagcacaatgg

SEQ ID NO: 1435 - DNA, 17 bp, Homo sapiens
gaggtgagcacaatggt

SEQ ID NO: 1436 - DNA, 17 bp, Homo sapiens
aggtgagcacaatggtg

SEQ ID NO: 1437 - DNA, 17 bp, Homo sapiens
ggtgagcacaatggtgg

SEQ ID NO: 1438 - DNA, 17 bp, Homo sapiens
gtgagcacaatggtgga

SEQ ID NO: 1439 - DNA, 17 bp, Homo sapiens
tgagcacaatggtggag

SEQ ID NO: 1440 - DNA, 17 bp, Homo sapiens
gagcacaatggtggagt

SEQ ID NO: 1441 - DNA, 17 bp, Homo sapiens
agcacaatggtggagtc

SEQ ID NO: 1442 - DNA, 17 bp, Homo sapiens
gcacaatggtggagtcg

SEQ ID NO: 1443 - DNA, 17 bp, Homo sapiens
cacaatggtggagtcgc

SEQ ID NO: 1444 - DNA, 17 bp, Homo sapiens
acaatggtggagtcgcc

SEQ ID NO: 1445 - DNA, 17 bp, Homo sapiens
caatggtggagtcgcca

SEQ ID NO: 1446 - DNA, 17 bp, Homo sapiens
aatggtggagtcgccag

SEQ ID NO: 1447 - DNA, 17 bp, Homo sapiens
atggtggagtcgccagc

SEQ ID NO: 1448 - DNA, 17 bp, Homo sapiens
tggtggagtcgccagca

SEQ ID NO: 1449 - DNA, 17 bp, Homo sapiens
ggtggagtcgccagcag

SEQ ID NO: 1450 - DNA, 17 bp, Homo sapiens
gtggagtcgccagcagc

SEQ ID NO: 1451 - DNA, 17 bp, Homo sapiens
tggagtcgccagcagct

SEQ ID NO: 1452 - DNA, 17 bp, Homo sapiens
ggagtcgccagcagctc

SEQ ID NO: 1453 - DNA, 17 bp, Homo sapiens
gagtcgccagcagctcc

SEQ ID NO: 1454 - DNA, 17 bp, Homo sapiens
agtcgccagcagctcct

SEQ ID NO: 1455 - DNA, 17 bp, Homo sapiens
gtcgccagcagctcctg

SEQ ID NO: 1456 - DNA, 17 bp, Homo sapiens
tcgccagcagctcctgg

SEQ ID NO: 1457 - DNA, 17 bp, Homo sapiens
cgccagcagctcctggg

SEQ ID NO: 1458 - DNA, 17 bp, Homo sapiens
gccagcagctcctggga

SEQ ID NO: 1459 - DNA, 17 bp, Homo sapiens
ccagcagctcctgggaa

SEQ ID NO: 1460 - DNA, 17 bp, Homo sapiens
cagcagctcctgggaag

SEQ ID NO: 1461 - DNA, 17 bp, Homo sapiens
agcagctcctgggaagg

SEQ ID NO: 1462 - DNA, 17 bp, Homo sapiens
gcagctcctgggaaggg

SEQ ID NO: 1463 - DNA, 17 bp, Homo sapiens
cagctcctgggaaggga

SEQ ID NO: 1464 - DNA, 17 bp, Homo sapiens
agctcctgggaagggag

SEQ ID NO: 1465 - DNA, 17 bp, Homo sapiens
gctcctgggaagggagg

SEQ ID NO: 1466 - DNA, 17 bp, Homo sapiens
ctcctgggaagggaggc

SEQ ID NO: 1467 - DNA, 17 bp, Homo sapiens
tcctgggaagggaggct

SEQ ID NO: 1468 - DNA, 17 bp, Homo sapiens
cctgggaagggaggctg

SEQ ID NO: 1469 - DNA, 17 bp, Homo sapiens
ctgggaagggaggctgg

SEQ ID NO: 1470 - DNA, 17 bp, Homo sapiens
tgggaagggaggctggc

SEQ ID NO: 1471 - DNA, 17 bp, Homo sapiens
gggaagggaggctggcc

SEQ ID NO: 1472 - DNA, 17 bp, Homo sapiens
ggaagggaggctggcca

SEQ ID NO: 1473 - DNA, 17 bp, Homo sapiens
gaagggaggctggccag

SEQ ID NO: 1474 - DNA, 17 bp, Homo sapiens
aagggaggctggccagg

SEQ ID NO: 1475 - DNA, 17 bp, Homo sapiens
agggaggctggccagga

SEQ ID NO: 1476 - DNA, 17 bp, Homo sapiens
gggaggctggccaggaa

SEQ ID NO: 1477 - DNA, 17 bp, Homo sapiens
ggaggctggccaggaag

SEQ ID NO: 1478 - DNA, 17 bp, Homo sapiens
gaggctggccaggaagc

SEQ ID NO: 1479 - DNA, 17 bp, Homo sapiens
aggctggccaggaagcc

SEQ ID NO: 1480 - DNA, 17 bp, Homo sapiens
ggctggccaggaagccg

SEQ ID NO: 1481 - DNA, 17 bp, Homo sapiens
gctggccaggaagccgt

SEQ ID NO: 1482 - DNA, 17 bp, Homo sapiens
ctggccaggaagccgtg

SEQ ID NO: 1483 - DNA, 17 bp, Homo sapiens
tggccaggaagccgtgg

SEQ ID NO: 1484 - DNA, 17 bp, Homo sapiens
ggccaggaagccgtggg

SEQ ID NO: 1485 - DNA, 17 bp, Homo sapiens
gccaggaagccgtgggc

SEQ ID NO: 1486 - DNA, 17 bp, Homo sapiens
ccaggaagccgtgggca

SEQ ID NO: 1487 - DNA, 17 bp, Homo sapiens
caggaagccgtgggcag

SEQ ID NO: 1488 - DNA, 17 bp, Homo sapiens
aggaagccgtgggcagg

SEQ ID NO: 1489 - DNA, 17 bp, Homo sapiens
ggaagccgtgggcagga

SEQ ID NO: 1490 - DNA, 17 bp, Homo sapiens
gaagccgtgggcaggaa

SEQ ID NO: 1491 - DNA, 17 bp, Homo sapiens
aagccgtgggcaggaag

SEQ ID NO: 1492 - DNA, 17 bp, Homo sapiens
agccgtgggcaggaagc

SEQ ID NO: 1493 - DNA, 17 bp, Homo sapiens
gccgtgggcaggaagca

SEQ ID NO: 1494 - DNA, 17 bp, Homo sapiens
ccgtgggcaggaagcag

SEQ ID NO: 1495 - DNA, 17 bp, Homo sapiens
cgtgggcaggaagcaga

SEQ ID NO: 1496 - DNA, 17 bp, Homo sapiens
gtgggcaggaagcagag

SEQ ID NO: 1497 - DNA, 17 bp, Homo sapiens
tgggcaggaagcagagg

SEQ ID NO: 1498 - DNA, 17 bp, Homo sapiens
gggcaggaagcagagga

SEQ ID NO: 1499 - DNA, 17 bp, Homo sapiens
ggcaggaagcagaggag

SEQ ID NO: 1500 - DNA, 17 bp, Homo sapiens
gcaggaagcagaggagc

SEQ ID NO: 1501 - DNA, 17 bp, Homo sapiens
caggaagcagaggagcc

SEQ ID NO: 1502 - DNA, 17 bp, Homo sapiens
aggaagcagaggagccc

SEQ ID NO: 1503 - DNA, 17 bp, Homo sapiens
ggaagcagaggagccct

SEQ ID NO: 1504 - DNA, 17 bp, Homo sapiens
gaagcagaggagccctg

SEQ ID NO: 1505 - DNA, 17 bp, Homo sapiens
aagcagaggagccctgc

SEQ ID NO: 1506 - DNA, 17 bp, Homo sapiens
agcagaggagccctgct

SEQ ID NO: 1507 - DNA, 17 bp, Homo sapiens
gcagaggagccctgctc

SEQ ID NO: 1508 - DNA, 17 bp, Homo sapiens
cagaggagccctgctca

SEQ ID NO: 1509 - DNA, 17 bp, Homo sapiens
agaggagccctgctcaa

SEQ ID NO: 1510 - DNA, 17 bp, Homo sapiens
gaggagccctgctcaag

SEQ ID NO: 1511 - DNA, 17 bp, Homo sapiens
aggagccctgctcaaga

SEQ ID NO: 1512 - DNA, 17 bp, Homo sapiens
ggagccctgctcaagag

SEQ ID NO: 1513 - DNA, 17 bp, Homo sapiens
gagccctgctcaagagc

SEQ ID NO: 1514 - DNA, 17 bp, Homo sapiens
agccctgctcaagagca

SEQ ID NO: 1515 - DNA, 17 bp, Homo sapiens
gccctgctcaagagcag

SEQ ID NO: 1516 - DNA, 17 bp, Homo sapiens
ccctgctcaagagcagg

SEQ ID NO: 1517 - DNA, 17 bp, Homo sapiens
cctgctcaagagcaggt

SEQ ID NO: 1518 - DNA, 17 bp, Homo sapiens
ctgctcaagagcaggtg

SEQ ID NO: 1519 - DNA, 17 bp, Homo sapiens
tgctcaagagcaggtga

SEQ ID NO: 1520 - DNA, 17 bp, Homo sapiens
gctcaagagcaggtgat

SEQ ID NO: 1521 - DNA, 17 bp, Homo sapiens
ctcaagagcaggtgatg

SEQ ID NO: 1522 - DNA, 17 bp, Homo sapiens
tcaagagcaggtgatgg

SEQ ID NO: 1523 - DNA, 17 bp, Homo sapiens
caagagcaggtgatggg

SEQ ID NO: 1524 - DNA, 17 bp, Homo sapiens
aagagcaggtgatgggg

SEQ ID NO: 1525 - DNA, 17 bp, Homo sapiens
agagcaggtgatggggc

SEQ ID NO: 1526 - DNA, 17 bp, Homo sapiens
gagcaggtgatggggct

SEQ ID NO: 1527 - DNA, 17 bp, Homo sapiens
agcaggtgatggggctg

SEQ ID NO: 1528 - DNA, 17 bp, Homo sapiens
gcaggtgatggggctgg

SEQ ID NO: 1529 - DNA, 17 bp, Homo sapiens
caggtgatggggctggt

SEQ ID NO: 1530 - DNA, 17 bp, Homo sapiens
aggtgatggggctggtg

SEQ ID NO: 1531 - DNA, 17 bp, Homo sapiens
ggtgatggggctggtgc

SEQ ID NO: 1532 - DNA, 17 bp, Homo sapiens
gtgatggggctggtgcc

SEQ ID NO: 1533 - DNA, 17 bp, Homo sapiens
tgatggggctggtgccc

SEQ ID NO: 1534 - DNA, 17 bp, Homo sapiens
gatggggctggtgccct

SEQ ID NO: 1535 - DNA, 17 bp, Homo sapiens
atggggctggtgccctg

SEQ ID NO: 1536 - DNA, 17 bp, Homo sapiens
tggggctggtgccctgg

SEQ ID NO: 1537 - DNA, 17 bp, Homo sapiens
ggggctggtgccctgga

SEQ ID NO: 1538 - DNA, 17 bp, Homo sapiens
gggctggtgccctggag

SEQ ID NO: 1539 - DNA, 17 bp, Homo sapiens
ggctggtgccctggaga

SEQ ID NO: 1540 - DNA, 17 bp, Homo sapiens
gctggtgccctggagac

SEQ ID NO: 1541 - DNA, 17 bp, Homo sapiens
ctggtgccctggagaca

SEQ ID NO: 1542 - DNA, 17 bp, Homo sapiens
tggtgccctggagacag

SEQ ID NO: 1543 - DNA, 17 bp, Homo sapiens
ggtgccctggagacaga

SEQ ID NO: 1544 - DNA, 17 bp, Homo sapiens
gtgccctggagacagag

SEQ ID NO: 1545 - DNA, 17 bp, Homo sapiens
tgccctggagacagagc

SEQ ID NO: 1546 - DNA, 17 bp, Homo sapiens
gccctggagacagagct

SEQ ID NO: 1547 - DNA, 17 bp, Homo sapiens
ccctggagacagagctg

SEQ ID NO: 1548 - DNA, 17 bp, Homo sapiens
cctggagacagagctgg

SEQ ID NO: 1549 - DNA, 17 bp, Homo sapiens
ctggagacagagctgga

SEQ ID NO: 1550 - DNA, 17 bp, Homo sapiens
tggagacagagctggaa

SEQ ID NO: 1551 - DNA, 17 bp, Homo sapiens
ggagacagagctggaag

SEQ ID NO: 1552 - DNA, 17 bp, Homo sapiens
gagacagagctggaagg

SEQ ID NO: 1553 - DNA, 17 bp, Homo sapiens
agacagagctggaagga

SEQ ID NO: 1554 - DNA, 17 bp, Homo sapiens
gacagagctggaaggac

SEQ ID NO: 1555 - DNA, 17 bp, Homo sapiens
acagagctggaaggacc

SEQ ID NO: 1556 - DNA, 17 bp, Homo sapiens
cagagctggaaggaccc

SEQ ID NO: 1557 - DNA, 17 bp, Homo sapiens
agagctggaaggaccca

SEQ ID NO: 1558 - DNA, 17 bp, Homo sapiens
gagctggaaggacccag

SEQ ID NO: 1559 - DNA, 17 bp, Homo sapiens
agctggaaggacccagc

SEQ ID NO: 1560 - DNA, 17 bp, Homo sapiens
gctggaaggacccagcc

SEQ ID NO: 1561 - DNA, 17 bp, Homo sapiens
ctggaaggacccagcca

SEQ ID NO: 1562 - DNA, 17 bp, Homo sapiens
tggaaggacccagccag

SEQ ID NO: 1563 - DNA, 17 bp, Homo sapiens
ggaaggacccagccagc

SEQ ID NO: 1564 - DNA, 17 bp, Homo sapiens
gaaggacccagccagcc

SEQ ID NO: 1565 - DNA, 17 bp, Homo sapiens
aaggacccagccagcct

SEQ ID NO: 1566 - DNA, 17 bp, Homo sapiens
aggacccagccagcctg

SEQ ID NO: 1567 - DNA, 17 bp, Homo sapiens
ggacccagccagcctgc

SEQ ID NO: 1568 - DNA, 17 bp, Homo sapiens
gacccagccagcctgct

SEQ ID NO: 1569 - DNA, 17 bp, Homo sapiens
acccagccagcctgctc

SEQ ID NO: 1570 - DNA, 17 bp, Homo sapiens
cccagccagcctgctct

SEQ ID NO: 1571 - DNA, 17 bp, Homo sapiens
ccagccagcctgctctg

SEQ ID NO: 1572 - DNA, 17 bp, Homo sapiens
cagccagcctgctctgg

SEQ ID NO: 1573 - DNA, 17 bp, Homo sapiens
agccagcctgctctgga

SEQ ID NO: 1574 - DNA, 17 bp, Homo sapiens
gccagcctgctctggag

SEQ ID NO: 1575 - DNA, 17 bp, Homo sapiens
ccagcctgctctggaga

SEQ ID NO: 1576 - DNA, 17 bp, Homo sapiens
cagcctgctctggagaa

SEQ ID NO: 1577 - DNA, 17 bp, Homo sapiens
agcctgctctggagaag

SEQ ID NO: 1578 - DNA, 17 bp, Homo sapiens
gcctgctctggagaagg

SEQ ID NO: 1579 - DNA, 17 bp, Homo sapiens
cctgctctggagaagga

SEQ ID NO: 1580 - DNA, 17 bp, Homo sapiens
ctgctctggagaaggat

SEQ ID NO: 1581 - DNA, 17 bp, Homo sapiens
tgctctggagaaggatg

SEQ ID NO: 1582 - DNA, 17 bp, Homo sapiens
gctctggagaaggatgc

SEQ ID NO: 1583 - DNA, 17 bp, Homo sapiens
ctctggagaaggatgca

SEQ ID NO: 1584 - DNA, 17 bp, Homo sapiens
tctggagaaggatgcag

SEQ ID NO: 1585 - DNA, 17 bp, Homo sapiens
ctggagaaggatgcaga

SEQ ID NO: 1586 - DNA, 17 bp, Homo sapiens
tggagaaggatgcagaa

SEQ ID NO: 1587 - DNA, 17 bp, Homo sapiens
ggagaaggatgcagaaa

SEQ ID NO: 1588 - DNA, 17 bp, Homo sapiens
gagaaggatgcagaaag

SEQ ID NO: 1589 - DNA, 17 bp, Homo sapiens
agaaggatgcagaaagg

SEQ ID NO: 1590 - DNA, 17 bp, Homo sapiens
gaaggatgcagaaaggc

SEQ ID NO: 1591 - DNA, 17 bp, Homo sapiens
aaggatgcagaaaggcc

SEQ ID NO: 1592 - DNA, 17 bp, Homo sapiens
aggatgcagaaaggcct

SEQ ID NO: 1593 - DNA, 17 bp, Homo sapiens
ggatgcagaaaggcctc

SEQ ID NO: 1594 - DNA, 17 bp, Homo sapiens
gatgcagaaaggcctcg

SEQ ID NO: 1595 - DNA, 17 bp, Homo sapiens
atgcagaaaggcctcgg

SEQ ID NO: 1596 - DNA, 17 bp, Homo sapiens
tgcagaaaggcctcgga

SEQ ID NO: 1597 - DNA, 17 bp, Homo sapiens
gcagaaaggcctcggat

SEQ ID NO: 1598 - DNA, 17 bp, Homo sapiens
cagaaaggcctcggata

SEQ ID NO: 1599 - DNA, 17 bp, Homo sapiens
agaaaggcctcggatac

SEQ ID NO: 1600 - DNA, 17 bp, Homo sapiens
gaaaggcctcggatacg

SEQ ID NO: 1601 - DNA, 17 bp, Homo sapiens
aaaggcctcggatacgg

SEQ ID NO: 1602 - DNA, 17 bp, Homo sapiens
aaggcctcggatacgga

SEQ ID NO: 1603 - DNA, 17 bp, Homo sapiens
aggcctcggatacggaa

SEQ ID NO: 1604 - DNA, 17 bp, Homo sapiens
ggcctcggatacggaag

SEQ ID NO: 1605 - DNA, 17 bp, Homo sapiens
gcctcggatacggaagg

SEQ ID NO: 1606 - DNA, 17 bp, Homo sapiens
cctcggatacggaagga

SEQ ID NO: 1607 - DNA, 17 bp, Homo sapiens
ctcggatacggaaggag

SEQ ID NO: 1608 - DNA, 17 bp, Homo sapiens
tcggatacggaaggaga

SEQ ID NO: 1609 - DNA, 17 bp, Homo sapiens
cggatacggaaggagaa

SEQ ID NO: 1610 - DNA, 17 bp, Homo sapiens
ggatacggaaggagaac

SEQ ID NO: 1611 - DNA, 17 bp, Homo sapiens
gatacggaaggagaacc

SEQ ID NO: 1612 - DNA, 17 bp, Homo sapiens
atacggaaggagaacca

SEQ ID NO: 1613 - DNA, 17 bp, Homo sapiens
tacggaaggagaaccaa

SEQ ID NO: 1614 - DNA, 17 bp, Homo sapiens
acggaaggagaaccaag

SEQ ID NO: 1615 - DNA, 17 bp, Homo sapiens
cggaaggagaaccaaga

SEQ ID NO: 1616 - DNA, 17 bp, Homo sapiens
ggaaggagaaccaagac

SEQ ID NO: 1617 - DNA, 17 bp, Homo sapiens
gaaggagaaccaagacg

SEQ ID NO: 1618 - DNA, 17 bp, Homo sapiens
aaggagaaccaagacgg

SEQ ID NO: 1619 - DNA, 17 bp, Homo sapiens
aggagaaccaagacggg

SEQ ID NO: 1620 - DNA, 17 bp, Homo sapiens
ggagaaccaagacgggc

SEQ ID NO: 1621 - DNA, 17 bp, Homo sapiens
gagaaccaagacgggcc

SEQ ID NO: 1622 - DNA, 17 bp, Homo sapiens
agaaccaagacgggcca

SEQ ID NO: 1623 - DNA, 17 bp, Homo sapiens
gaaccaagacgggccag

SEQ ID NO: 1624 - DNA, 17 bp, Homo sapiens
aaccaagacgggccagc

SEQ ID NO: 1625 - DNA, 17 bp, Homo sapiens
accaagacgggccagcc

SEQ ID NO: 1626 - DNA, 17 bp, Homo sapiens
ccaagacgggccagccc

SEQ ID NO: 1627 - DNA, 17 bp, Homo sapiens
caagacgggccagcccc

SEQ ID NO: 1628 - DNA, 17 bp, Homo sapiens
aagacgggccagccccg

SEQ ID NO: 1629 - DNA, 17 bp, Homo sapiens
agacgggccagccccgc

SEQ ID NO: 1630 - DNA, 17 bp, Homo sapiens
gacgggccagccccgca

SEQ ID NO: 1631 - DNA, 17 bp, Homo sapiens
acgggccagccccgcag

SEQ ID NO: 1632 - DNA, 17 bp, Homo sapiens
cgggccagccccgcagg

SEQ ID NO: 1633 - DNA, 17 bp, Homo sapiens
gggccagccccgcagga

SEQ ID NO: 1634 - DNA, 17 bp, Homo sapiens
ggccagccccgcaggag

SEQ ID NO: 1635 - DNA, 17 bp, Homo sapiens
gccagccccgcaggagg

SEQ ID NO: 1636 - DNA, 17 bp, Homo sapiens
ccagccccgcaggagga

SEQ ID NO: 1637 - DNA, 17 bp, Homo sapiens
cagccccgcaggaggag

SEQ ID NO: 1638 - DNA, 17 bp, Homo sapiens
agccccgcaggaggagg

SEQ ID NO: 1639 - DNA, 17 bp, Homo sapiens
gccccgcaggaggaggg

SEQ ID NO: 1640 - DNA, 17 bp, Homo sapiens
ccccgcaggaggagggc

SEQ ID NO: 1641 - DNA, 17 bp, Homo sapiens
cccgcaggaggagggca

SEQ ID NO: 1642 - DNA, 17 bp, Homo sapiens
ccgcaggaggagggcaa

SEQ ID NO: 1643 - DNA, 17 bp, Homo sapiens
cgcaggaggagggcaaa

SEQ ID NO: 1644 - DNA, 17 bp, Homo sapiens
gcaggaggagggcaaag

SEQ ID NO: 1645 - DNA, 17 bp, Homo sapiens
caggaggagggcaaagg

SEQ ID NO: 1646 - DNA, 17 bp, Homo sapiens
aggaggagggcaaagga

SEQ ID NO: 1647 - DNA, 17 bp, Homo sapiens
ggaggagggcaaaggag

SEQ ID NO: 1648 - DNA, 17 bp, Homo sapiens
gaggagggcaaaggagg

SEQ ID NO: 1649 - DNA, 17 bp, Homo sapiens
aggagggcaaaggaggc

SEQ ID NO: 1650 - DNA, 17 bp, Homo sapiens
ggagggcaaaggaggcc

SEQ ID NO: 1651 - DNA, 17 bp, Homo sapiens
gagggcaaaggaggcca

SEQ ID NO: 1652 - DNA, 17 bp, Homo sapiens
agggcaaaggaggccag

SEQ ID NO: 1653 - DNA, 17 bp, Homo sapiens
gggcaaaggaggccaga

SEQ ID NO: 1654 - DNA, 17 bp, Homo sapiens
ggcaaaggaggccagag

SEQ ID NO: 1655 - DNA, 17 bp, Homo sapiens
gcaaaggaggccagagc

SEQ ID NO: 1656 - DNA, 17 bp, Homo sapiens
caaaggaggccagagca

SEQ ID NO: 1657 - DNA, 17 bp, Homo sapiens
aaaggaggccagagcag

SEQ ID NO: 1658 - DNA, 17 bp, Homo sapiens
aaggaggccagagcaga

SEQ ID NO: 1659 - DNA, 17 bp, Homo sapiens
aggaggccagagcagag

SEQ ID NO: 1660 - DNA, 17 bp, Homo sapiens
ggaggccagagcagaga

SEQ ID NO: 1661 - DNA, 17 bp, Homo sapiens
gaggccagagcagagac

SEQ ID NO: 1662 - DNA, 17 bp, Homo sapiens
aggccagagcagagact

SEQ ID NO: 1663 - DNA, 17 bp, Homo sapiens
ggccagagcagagactc

SEQ ID NO: 1664 - DNA, 17 bp, Homo sapiens
gccagagcagagactca

SEQ ID NO: 1665 - DNA, 17 bp, Homo sapiens
ccagagcagagactcag

SEQ ID NO: 1666 - DNA, 17 bp, Homo sapiens
cagagcagagactcaga

SEQ ID NO: 1667 - DNA, 17 bp, Homo sapiens
agagcagagactcagac

SEQ ID NO: 1668 - DNA, 17 bp, Homo sapiens
gagcagagactcagacc

SEQ ID NO: 1669 - DNA, 17 bp, Homo sapiens
agcagagactcagacca

SEQ ID NO: 1670 - DNA, 17 bp, Homo sapiens
gcagagactcagaccag

SEQ ID NO: 1671 - DNA, 17 bp, Homo sapiens
cagagactcagaccagg

SEQ ID NO: 1672 - DNA, 17 bp, Homo sapiens
agagactcagaccaggc

SEQ ID NO: 1673 - DNA, 17 bp, Homo sapiens
gagactcagaccaggct

SEQ ID NO: 1674 - DNA, 17 bp, Homo sapiens
agactcagaccaggctc

SEQ ID NO: 1675 - DNA, 17 bp, Homo sapiens
gactcagaccaggctcc

SEQ ID NO: 1676 - DNA, 17 bp, Homo sapiens
actcagaccaggctcct

SEQ ID NO: 1677 - DNA, 17 bp, Homo sapiens
ctcagaccaggctcctg

SEQ ID NO: 1678 - DNA, 17 bp, Homo sapiens
tcagaccaggctcctga

SEQ ID NO: 1679 - DNA, 17 bp, Homo sapiens
cagaccaggctcctgag

SEQ ID NO: 1680 - DNA, 17 bp, Homo sapiens
agaccaggctcctgagg

SEQ ID NO: 1681 - DNA, 17 bp, Homo sapiens
gaccaggctcctgagga

SEQ ID NO: 1682 - DNA, 17 bp, Homo sapiens
accaggctcctgaggac

SEQ ID NO: 1683 - DNA, 17 bp, Homo sapiens
ccaggctcctgaggaca

SEQ ID NO: 1684 - DNA, 17 bp, Homo sapiens
caggctcctgaggacag

SEQ ID NO: 1685 - DNA, 17 bp, Homo sapiens
aggctcctgaggacaga

SEQ ID NO: 1686 - DNA, 17 bp, Homo sapiens
ggctcctgaggacagat

SEQ ID NO: 1687 - DNA, 17 bp, Homo sapiens
gctcctgaggacagatg

SEQ ID NO: 1688 - DNA, 17 bp, Homo sapiens
ctcctgaggacagatgg

SEQ ID NO: 1689 - DNA, 17 bp, Homo sapiens
tcctgaggacagatggt

SEQ ID NO: 1690 - DNA, 17 bp, Homo sapiens
cctgaggacagatggta

SEQ ID NO: 1691 - DNA, 17 bp, Homo sapiens
ctgaggacagatggtat

SEQ ID NO: 1692 - DNA, 17 bp, Homo sapiens
tgaggacagatggtatg

SEQ ID NO: 1693 - DNA, 17 bp, Homo sapiens
gaggacagatggtatga

SEQ ID NO: 1694 - DNA, 17 bp, Homo sapiens
aggacagatggtatgag

SEQ ID NO: 1695 - DNA, 17 bp, Homo sapiens
ggacagatggtatgagg

SEQ ID NO: 1696 - DNA, 17 bp, Homo sapiens
gacagatggtatgaggc

SEQ ID NO: 1697 - DNA, 17 bp, Homo sapiens
acagatggtatgaggca

SEQ ID NO: 1698 - DNA, 17 bp, Homo sapiens
cagatggtatgaggcag

SEQ ID NO: 1699 - DNA, 17 bp, Homo sapiens
agatggtatgaggcaga

SEQ ID NO: 1700 - DNA, 17 bp, Homo sapiens
gatggtatgaggcagag

SEQ ID NO: 1701 - DNA, 17 bp, Homo sapiens
atggtatgaggcagaga

SEQ ID NO: 1702 - DNA, 17 bp, Homo sapiens
tggtatgaggcagagaa

SEQ ID NO: 1703 - DNA, 17 bp, Homo sapiens
ggtatgaggcagagaaa

SEQ ID NO: 1704 - DNA, 17 bp, Homo sapiens
gtatgaggcagagaaag

SEQ ID NO: 1705 - DNA, 17 bp, Homo sapiens
tatgaggcagagaaagt

SEQ ID NO: 1706 - DNA, 17 bp, Homo sapiens
atgaggcagagaaagtc

SEQ ID NO: 1707 - DNA, 17 bp, Homo sapiens
tgaggcagagaaagtct

SEQ ID NO: 1708 - DNA, 17 bp, Homo sapiens
gaggcagagaaagtctg

SEQ ID NO: 1709 - DNA, 17 bp, Homo sapiens
aggcagagaaagtctgg

SEQ ID NO: 1710 - DNA, 17 bp, Homo sapiens
ggcagagaaagtctggc

SEQ ID NO: 1711 - DNA, 17 bp, Homo sapiens
gcagagaaagtctggct

SEQ ID NO: 1712 - DNA, 17 bp, Homo sapiens
cagagaaagtctggctg

SEQ ID NO: 1713 - DNA, 17 bp, Homo sapiens
agagaaagtctggctgg

SEQ ID NO: 1714 - DNA, 17 bp, Homo sapiens
gagaaagtctggctggc

SEQ ID NO: 1715 - DNA, 17 bp, Homo sapiens
agaaagtctggctggct

SEQ ID NO: 1716 - DNA, 17 bp, Homo sapiens
gaaagtctggctggctc

SEQ ID NO: 1717 - DNA, 17 bp, Homo sapiens
aaagtctggctggctca

SEQ ID NO: 1718 - DNA, 17 bp, Homo sapiens
aagtctggctggctcag

SEQ ID NO: 1719 - DNA, 17 bp, Homo sapiens
agtctggctggctcaga

SEQ ID NO: 1720 - DNA, 17 bp, Homo sapiens
gtctggctggctcagaa

SEQ ID NO: 1721 - DNA, 17 bp, Homo sapiens
tctggctggctcagaag

SEQ ID NO: 1722 - DNA, 17 bp, Homo sapiens
ctggctggctcagaagg

SEQ ID NO: 1723 - DNA, 17 bp, Homo sapiens
tggctggctcagaagga

SEQ ID NO: 1724 - DNA, 17 bp, Homo sapiens
ggctggctcagaaggat

SEQ ID NO: 1725 - DNA, 17 bp, Homo sapiens
gctggctcagaaggatg

SEQ ID NO: 1726 - DNA, 17 bp, Homo sapiens
ctggctcagaaggatgg

SEQ ID NO: 1727 - DNA, 17 bp, Homo sapiens
tggctcagaaggatgga

SEQ ID NO: 1728 - DNA, 17 bp, Homo sapiens
ggctcagaaggatggat

SEQ ID NO: 1729 - DNA, 17 bp, Homo sapiens
gctcagaaggatggatt

SEQ ID NO: 1730 - DNA, 17 bp, Homo sapiens
ctcagaaggatggattt

SEQ ID NO: 1731 - DNA, 17 bp, Homo sapiens
tcagaaggatggattta

SEQ ID NO: 1732 - DNA, 17 bp, Homo sapiens
cagaaggatggatttac

SEQ ID NO: 1733 - DNA, 17 bp, Homo sapiens
agaaggatggatttact

SEQ ID NO: 1734 - DNA, 17 bp, Homo sapiens
gaaggatggatttactc

SEQ ID NO: 1735 - DNA, 17 bp, Homo sapiens
aaggatggatttactct

SEQ ID NO: 1736 - DNA, 17 bp, Homo sapiens
aggatggatttactctt

SEQ ID NO: 1737 - DNA, 17 bp, Homo sapiens
ggatggatttactcttg

SEQ ID NO: 1738 - DNA, 17 bp, Homo sapiens
gatggatttactcttgc

SEQ ID NO: 1739 - DNA, 17 bp, Homo sapiens
atggatttactcttgct

SEQ ID NO: 1740 - DNA, 17 bp, Homo sapiens
tggatttactcttgcta

SEQ ID NO: 1741 - DNA, 17 bp, Homo sapiens
ggatttactcttgctac

SEQ ID NO: 1742 - DNA, 17 bp, Homo sapiens
gatttactcttgctacg

SEQ ID NO: 1743 - DNA, 17 bp, Homo sapiens
atttactcttgctacgg

SEQ ID NO: 1744 - DNA, 17 bp, Homo sapiens
tttactcttgctacggt

SEQ ID NO: 1745 - DNA, 17 bp, Homo sapiens
ttactcttgctacggtg

SEQ ID NO: 1746 - DNA, 17 bp, Homo sapiens
tactcttgctacggtgc

SEQ ID NO: 1747 - DNA, 17 bp, Homo sapiens
actcttgctacggtgct

SEQ ID NO: 1748 - DNA, 17 bp, Homo sapiens
ctcttgctacggtgcta

SEQ ID NO: 1749 - DNA, 17 bp, Homo sapiens
tcttgctacggtgctaa

SEQ ID NO: 1750 - DNA, 17 bp, Homo sapiens
cttgctacggtgctaaa

SEQ ID NO: 1751 - DNA, 17 bp, Homo sapiens
ttgctacggtgctaaag

SEQ ID NO: 1752 - DNA, 17 bp, Homo sapiens
tgctacggtgctaaagc

SEQ ID NO: 1753 - DNA, 17 bp, Homo sapiens
gctacggtgctaaagcc

SEQ ID NO: 1754 - DNA, 17 bp, Homo sapiens
ctacggtgctaaagcca

SEQ ID NO: 1755 - DNA, 17 bp, Homo sapiens
tacggtgctaaagccag

SEQ ID NO: 1756 - DNA, 17 bp, Homo sapiens
acggtgctaaagccaga

SEQ ID NO: 1757 - DNA, 17 bp, Homo sapiens
cggtgctaaagccagat

SEQ ID NO: 1758 - DNA, 17 bp, Homo sapiens
ggtgctaaagccagatg

SEQ ID NO: 1759 - DNA, 17 bp, Homo sapiens
gtgctaaagccagatga

SEQ ID NO: 1760 - DNA, 17 bp, Homo sapiens
tgctaaagccagatgag

SEQ ID NO: 1761 - DNA, 17 bp, Homo sapiens
gctaaagccagatgagg

SEQ ID NO: 1762 - DNA, 17 bp, Homo sapiens
ctaaagccagatgaggg

SEQ ID NO: 1763 - DNA, 17 bp, Homo sapiens
taaagccagatgaggga

SEQ ID NO: 1764 - DNA, 17 bp, Homo sapiens
aaagccagatgagggaa

SEQ ID NO: 1765 - DNA, 17 bp, Homo sapiens
aagccagatgagggaac

SEQ ID NO: 1766 - DNA, 17 bp, Homo sapiens
agccagatgagggaaca

SEQ ID NO: 1767 - DNA, 17 bp, Homo sapiens
gccagatgagggaacag

SEQ ID NO: 1768 - DNA, 17 bp, Homo sapiens
ccagatgagggaacagc

SEQ ID NO: 1769 - DNA, 17 bp, Homo sapiens
cagatgagggaacagca

SEQ ID NO: 1770 - DNA, 17 bp, Homo sapiens
agatgagggaacagcag

SEQ ID NO: 1771 - DNA, 17 bp, Homo sapiens
gatgagggaacagcaga

SEQ ID NO: 1772 - DNA, 17 bp, Homo sapiens
atgagggaacagcagac

SEQ ID NO: 1773 - DNA, 17 bp, Homo sapiens
tgagggaacagcagacc

SEQ ID NO: 1774 - DNA, 17 bp, Homo sapiens
gagggaacagcagacct

SEQ ID NO: 1775 - DNA, 17 bp, Homo sapiens
agggaacagcagacctg

SEQ ID NO: 1776 - DNA, 17 bp, Homo sapiens
gggaacagcagacctgc

SEQ ID NO: 1777 - DNA, 17 bp, Homo sapiens
ggaacagcagacctgcc

SEQ ID NO: 1778 - DNA, 17 bp, Homo sapiens
gaacagcagacctgcca

SEQ ID NO: 1779 - DNA, 17 bp, Homo sapiens
aacagcagacctgccag

SEQ ID NO: 1780 - DNA, 17 bp, Homo sapiens
acagcagacctgccagc

SEQ ID NO: 1781 - DNA, 17 bp, Homo sapiens
cagcagacctgccagca

SEQ ID NO: 1782 - DNA, 17 bp, Homo sapiens
agcagacctgccagcag

SEQ ID NO: 1783 - DNA, 17 bp, Homo sapiens
gcagacctgccagcagg

SEQ ID NO: 1784 - DNA, 17 bp, Homo sapiens
cagacctgccagcagga

SEQ ID NO: 1785 - DNA, 17 bp, Homo sapiens
agacctgccagcaggaa

SEQ ID NO: 1786 - DNA, 17 bp, Homo sapiens
gacctgccagcaggaag

SEQ ID NO: 1787 - DNA, 17 bp, Homo sapiens
acctgccagcaggaagg

SEQ ID NO: 1788 - DNA, 17 bp, Homo sapiens
cctgccagcaggaaggg

SEQ ID NO: 1789 - DNA, 17 bp, Homo sapiens
ctgccagcaggaagggt

SEQ ID NO: 1790 - DNA, 17 bp, Homo sapiens
tgccagcaggaagggtg

SEQ ID NO: 1791 - DNA, 17 bp, Homo sapiens
gccagcaggaagggtga

SEQ ID NO: 1792 - DNA, 17 bp, Homo sapiens
ccagcaggaagggtgag

SEQ ID NO: 1793 - DNA, 17 bp, Homo sapiens
cagcaggaagggtgaga

SEQ ID NO: 1794 - DNA, 17 bp, Homo sapiens
agcaggaagggtgagac

SEQ ID NO: 1795 - DNA, 17 bp, Homo sapiens
gcaggaagggtgagact

SEQ ID NO: 1796 - DNA, 17 bp, Homo sapiens
caggaagggtgagactt

SEQ ID NO: 1797 - DNA, 17 bp, Homo sapiens
aggaagggtgagacttt

SEQ ID NO: 1798 - DNA, 17 bp, Homo sapiens
ggaagggtgagactttg

SEQ ID NO: 1799 - DNA, 17 bp, Homo sapiens
gaagggtgagactttgc

SEQ ID NO: 1800 - DNA, 17 bp, Homo sapiens
aagggtgagactttgca

SEQ ID NO: 1801 - DNA, 17 bp, Homo sapiens
agggtgagactttgcat

SEQ ID NO: 1802 - DNA, 17 bp, Homo sapiens
gggtgagactttgcatt

SEQ ID NO: 1803 - DNA, 17 bp, Homo sapiens
ggtgagactttgcattg

SEQ ID NO: 1804 - DNA, 17 bp, Homo sapiens
gtgagactttgcattga

SEQ ID NO: 1805 - DNA, 17 bp, Homo sapiens
tgagactttgcattgat

SEQ ID NO: 1806 - DNA, 17 bp, Homo sapiens
gagactttgcattgatg

SEQ ID NO: 1807 - DNA, 17 bp, Homo sapiens
agactttgcattgatgc

SEQ ID NO: 1808 - DNA, 17 bp, Homo sapiens
gactttgcattgatgct

SEQ ID NO: 1809 - DNA, 17 bp, Homo sapiens
actttgcattgatgctg

SEQ ID NO: 1810 - DNA, 17 bp, Homo sapiens
ctttgcattgatgctga

SEQ ID NO: 1811 - DNA, 17 bp, Homo sapiens
tttgcattgatgctgac

SEQ ID NO: 1812 - DNA, 17 bp, Homo sapiens
ttgcattgatgctgaca

SEQ ID NO: 1813 - DNA, 17 bp, Homo sapiens
tgcattgatgctgacaa

SEQ ID NO: 1814 - DNA, 17 bp, Homo sapiens
gcattgatgctgacaaa

SEQ ID NO: 1815 - DNA, 17 bp, Homo sapiens
cattgatgctgacaaaa

SEQ ID NO: 1816 - DNA, 17 bp, Homo sapiens
attgatgctgacaaaac

SEQ ID NO: 1817 - DNA, 17 bp, Homo sapiens
ttgatgctgacaaaacc

SEQ ID NO: 1818 - DNA, 17 bp, Homo sapiens
tgatgctgacaaaacca

SEQ ID NO: 1819 - DNA, 17 bp, Homo sapiens
gatgctgacaaaaccat

SEQ ID NO: 1820 - DNA, 17 bp, Homo sapiens
atgctgacaaaaccatc

SEQ ID NO: 1821 - DNA, 17 bp, Homo sapiens
tgctgacaaaaccatca

SEQ ID NO: 1822 - DNA, 17 bp, Homo sapiens
gctgacaaaaccatcac

SEQ ID NO: 1823 - DNA, 17 bp, Homo sapiens
ctgacaaaaccatcact

SEQ ID NO: 1824 - DNA, 17 bp, Homo sapiens
tgacaaaaccatcactg

SEQ ID NO: 1825 - DNA, 17 bp, Homo sapiens
gacaaaaccatcactga

SEQ ID NO: 1826 - DNA, 17 bp, Homo sapiens
acaaaaccatcactgag

SEQ ID NO: 1827 - DNA, 17 bp, Homo sapiens
caaaaccatcactgagg

SEQ ID NO: 1828 - DNA, 17 bp, Homo sapiens
aaaaccatcactgaggt

SEQ ID NO: 1829 - DNA, 17 bp, Homo sapiens
aaaccatcactgaggtg

SEQ ID NO: 1830 - DNA, 17 bp, Homo sapiens
aaccatcactgaggtgg

SEQ ID NO: 1831 - DNA, 17 bp, Homo sapiens
accatcactgaggtgga

SEQ ID NO: 1832 - DNA, 17 bp, Homo sapiens
ccatcactgaggtggat

SEQ ID NO: 1833 - DNA, 17 bp, Homo sapiens
catcactgaggtggatg

SEQ ID NO: 1834 - DNA, 17 bp, Homo sapiens
atcactgaggtggatga

SEQ ID NO: 1835 - DNA, 17 bp, Homo sapiens
tcactgaggtggatgag

SEQ ID NO: 1836 - DNA, 17 bp, Homo sapiens
cactgaggtggatgagg

SEQ ID NO: 1837 - DNA, 17 bp, Homo sapiens
actgaggtggatgagga

SEQ ID NO: 1838 - DNA, 17 bp, Homo sapiens
ctgaggtggatgaggag

SEQ ID NO: 1839 - DNA, 17 bp, Homo sapiens
tgaggtggatgaggagc

SEQ ID NO: 1840 - DNA, 17 bp, Homo sapiens
gaggtggatgaggagca

SEQ ID NO: 1841 - DNA, 17 bp, Homo sapiens
aggtggatgaggagcat

SEQ ID NO: 1842 - DNA, 17 bp, Homo sapiens
ggtggatgaggagcatg

SEQ ID NO: 1843 - DNA, 17 bp, Homo sapiens
gtggatgaggagcatgt

SEQ ID NO: 1844 - DNA, 17 bp, Homo sapiens
tggatgaggagcatgtc

SEQ ID NO: 1845 - DNA, 17 bp, Homo sapiens
ggatgaggagcatgtcc

SEQ ID NO: 1846 - DNA, 17 bp, Homo sapiens
gatgaggagcatgtcca

SEQ ID NO: 1847 - DNA, 17 bp, Homo sapiens
atgaggagcatgtccat

SEQ ID NO: 1848 - DNA, 17 bp, Homo sapiens
tgaggagcatgtccatc

SEQ ID NO: 1849 - DNA, 17 bp, Homo sapiens
gaggagcatgtccatcg

SEQ ID NO: 1850 - DNA, 17 bp, Homo sapiens
aggagcatgtccatcgg

SEQ ID NO: 1851 - DNA, 17 bp, Homo sapiens
ggagcatgtccatcggg

SEQ ID NO: 1852 - DNA, 17 bp, Homo sapiens
gagcatgtccatcgggc

SEQ ID NO: 1853 - DNA, 17 bp, Homo sapiens
agcatgtccatcgggcc

SEQ ID NO: 1854 - DNA, 17 bp, Homo sapiens
gcatgtccatcgggcca

SEQ ID NO: 1855 - DNA, 17 bp, Homo sapiens
catgtccatcgggccaa

SEQ ID NO: 1856 - DNA, 17 bp, Homo sapiens
atgtccatcgggccaac

SEQ ID NO: 1857 - DNA, 17 bp, Homo sapiens
tgtccatcgggccaacc

SEQ ID NO: 1858 - DNA, 17 bp, Homo sapiens
gtccatcgggccaaccc

SEQ ID NO: 1859 - DNA, 17 bp, Homo sapiens
tccatcgggccaaccct

SEQ ID NO: 1860 - DNA, 17 bp, Homo sapiens
ccatcgggccaaccctc

SEQ ID NO: 1861 - DNA, 17 bp, Homo sapiens
catcgggccaaccctcc

SEQ ID NO: 1862 - DNA, 17 bp, Homo sapiens
atcgggccaaccctcct

SEQ ID NO: 1863 - DNA, 17 bp, Homo sapiens
tcgggccaaccctcctg

SEQ ID NO: 1864 - DNA, 17 bp, Homo sapiens
cgggccaaccctcctga

SEQ ID NO: 1865 - DNA, 17 bp, Homo sapiens
gggccaaccctcctgag

SEQ ID NO: 1866 - DNA, 17 bp, Homo sapiens
ggccaaccctcctgagc

SEQ ID NO: 1867 - DNA, 17 bp, Homo sapiens
gccaaccctcctgagct

SEQ ID NO: 1868 - DNA, 17 bp, Homo sapiens
ccaaccctcctgagctg

SEQ ID NO: 1869 - DNA, 17 bp, Homo sapiens
caaccctcctgagctgg

SEQ ID NO: 1870 - DNA, 17 bp, Homo sapiens
aaccctcctgagctgga

SEQ ID NO: 1871 - DNA, 17 bp, Homo sapiens
accctcctgagctggac

SEQ ID NO: 1872 - DNA, 17 bp, Homo sapiens
ccctcctgagctggacc

SEQ ID NO: 1873 - DNA, 17 bp, Homo sapiens
cctcctgagctggacca

SEQ ID NO: 1874 - DNA, 17 bp, Homo sapiens
ctcctgagctggaccag

SEQ ID NO: 1875 - DNA, 17 bp, Homo sapiens
tcctgagctggaccagg

SEQ ID NO: 1876 - DNA, 17 bp, Homo sapiens
cctgagctggaccaggt

SEQ ID NO: 1877 - DNA, 17 bp, Homo sapiens
ctgagctggaccaggtc

SEQ ID NO: 1878 - DNA, 17 bp, Homo sapiens
tgagctggaccaggtcg

SEQ ID NO: 1879 - DNA, 17 bp, Homo sapiens
gagctggaccaggtcga

SEQ ID NO: 1880 - DNA, 17 bp, Homo sapiens
agctggaccaggtcgag

SEQ ID NO: 1881 - DNA, 17 bp, Homo sapiens
gctggaccaggtcgagg

SEQ ID NO: 1882 - DNA, 17 bp, Homo sapiens
ctggaccaggtcgagga

SEQ ID NO: 1883 - DNA, 17 bp, Homo sapiens
tggaccaggtcgaggac

SEQ ID NO: 1884 - DNA, 17 bp, Homo sapiens
ggaccaggtcgaggacc

SEQ ID NO: 1885 - DNA, 17 bp, Homo sapiens
gaccaggtcgaggacct

SEQ ID NO: 1886 - DNA, 17 bp, Homo sapiens
accaggtcgaggacctg

SEQ ID NO: 1887 - DNA, 17 bp, Homo sapiens
ccaggtcgaggacctgg

SEQ ID NO: 1888 - DNA, 17 bp, Homo sapiens
caggtcgaggacctggc

SEQ ID NO: 1889 - DNA, 17 bp, Homo sapiens
aggtcgaggacctggcc

SEQ ID NO: 1890 - DNA, 17 bp, Homo sapiens
ggtcgaggacctggcct

SEQ ID NO: 1891 - DNA, 17 bp, Homo sapiens
gtcgaggacctggcctc

SEQ ID NO: 1892 - DNA, 17 bp, Homo sapiens
tcgaggacctggcctct

SEQ ID NO: 1893 - DNA, 17 bp, Homo sapiens
cgaggacctggcctctc

SEQ ID NO: 1894 - DNA, 17 bp, Homo sapiens
gaggacctggcctctct

SEQ ID NO: 1895 - DNA, 17 bp, Homo sapiens
aggacctggcctctctc

SEQ ID NO: 1896 - DNA, 17 bp, Homo sapiens
ggacctggcctctctca

SEQ ID NO: 1897 - DNA, 17 bp, Homo sapiens
gacctggcctctctcat

SEQ ID NO: 1898 - DNA, 17 bp, Homo sapiens
acctggcctctctcatc

SEQ ID NO: 1899 - DNA, 17 bp, Homo sapiens
cctggcctctctcatca

SEQ ID NO: 1900 - DNA, 17 bp, Homo sapiens
ctggcctctctcatcag

SEQ ID NO: 1901 - DNA, 17 bp, Homo sapiens
tggcctctctcatcagt

SEQ ID NO: 1902 - DNA, 17 bp, Homo sapiens
ggcctctctcatcagtg

SEQ ID NO: 1903 - DNA, 17 bp, Homo sapiens
gcctctctcatcagtgt

SEQ ID NO: 1904 - DNA, 17 bp, Homo sapiens
cctctctcatcagtgtc

SEQ ID NO: 1905 - DNA, 17 bp, Homo sapiens
ctctctcatcagtgtca

SEQ ID NO: 1906 - DNA, 17 bp, Homo sapiens
tctctcatcagtgtcaa

SEQ ID NO: 1907 - DNA, 17 bp, Homo sapiens
ctctcatcagtgtcaac

SEQ ID NO: 1908 - DNA, 17 bp, Homo sapiens
tctcatcagtgtcaacg

SEQ ID NO: 1909 - DNA, 17 bp, Homo sapiens
ctcatcagtgtcaacga

SEQ ID NO: 1910 - DNA, 17 bp, Homo sapiens
tcatcagtgtcaacgaa

SEQ ID NO: 1911 - DNA, 17 bp, Homo sapiens
catcagtgtcaacgaat

SEQ ID NO: 1912 - DNA, 17 bp, Homo sapiens
atcagtgtcaacgaatc

SEQ ID NO: 1913 - DNA, 17 bp, Homo sapiens
tcagtgtcaacgaatcc

SEQ ID NO: 1914 - DNA, 17 bp, Homo sapiens
cagtgtcaacgaatcca

SEQ ID NO: 1915 - DNA, 17 bp, Homo sapiens
agtgtcaacgaatccag

SEQ ID NO: 1916 - DNA, 17 bp, Homo sapiens
gtgtcaacgaatccagt

SEQ ID NO: 1917 - DNA, 17 bp, Homo sapiens
tgtcaacgaatccagtg

SEQ ID NO: 1918 - DNA, 17 bp, Homo sapiens
gtcaacgaatccagtgt

SEQ ID NO: 1919 - DNA, 17 bp, Homo sapiens
tcaacgaatccagtgtc

SEQ ID NO: 1920 - DNA, 17 bp, Homo sapiens
caacgaatccagtgtcc

SEQ ID NO: 1921 - DNA, 17 bp, Homo sapiens
aacgaatccagtgtcct

SEQ ID NO: 1922 - DNA, 17 bp, Homo sapiens
acgaatccagtgtcctg

SEQ ID NO: 1923 - DNA, 17 bp, Homo sapiens
cgaatccagtgtcctga

SEQ ID NO: 1924 - DNA, 17 bp, Homo sapiens
gaatccagtgtcctgaa

SEQ ID NO: 1925 - DNA, 17 bp, Homo sapiens
aatccagtgtcctgaac

SEQ ID NO: 1926 - DNA, 17 bp, Homo sapiens
atccagtgtcctgaaca

SEQ ID NO: 1927 - DNA, 17 bp, Homo sapiens
tccagtgtcctgaacac

SEQ ID NO: 1928 - DNA, 17 bp, Homo sapiens
ccagtgtcctgaacacg

SEQ ID NO: 1929 - DNA, 17 bp, Homo sapiens
cagtgtcctgaacacgc

SEQ ID NO: 1930 - DNA, 17 bp, Homo sapiens
agtgtcctgaacacgct

SEQ ID NO: 1931 - DNA, 17 bp, Homo sapiens
gtgtcctgaacacgctt

SEQ ID NO: 1932 - DNA, 17 bp, Homo sapiens
tgtcctgaacacgcttc

SEQ ID NO: 1933 - DNA, 17 bp, Homo sapiens
gtcctgaacacgcttct

SEQ ID NO: 1934 - DNA, 17 bp, Homo sapiens
tcctgaacacgcttctg

SEQ ID NO: 1935 - DNA, 17 bp, Homo sapiens
cctgaacacgcttctgc

SEQ ID NO: 1936 - DNA, 17 bp, Homo sapiens
ctgaacacgcttctgca

SEQ ID NO: 1937 - DNA, 17 bp, Homo sapiens
tgaacacgcttctgcag

SEQ ID NO: 1938 - DNA, 17 bp, Homo sapiens
gaacacgcttctgcagc

SEQ ID NO: 1939 - DNA, 17 bp, Homo sapiens
aacacgcttctgcagcg

SEQ ID NO: 1940 - DNA, 17 bp, Homo sapiens
acacgcttctgcagcgc

SEQ ID NO: 1941 - DNA, 17 bp, Homo sapiens
cacgcttctgcagcgct

SEQ ID NO: 1942 - DNA, 17 bp, Homo sapiens
acgcttctgcagcgcta

SEQ ID NO: 1943 - DNA, 17 bp, Homo sapiens
cgcttctgcagcgctac

SEQ ID NO: 1944 - DNA, 17 bp, Homo sapiens
gcttctgcagcgctaca

SEQ ID NO: 1945 - DNA, 17 bp, Homo sapiens
cttctgcagcgctacaa

SEQ ID NO: 1946 - DNA, 17 bp, Homo sapiens
ttctgcagcgctacaaa

SEQ ID NO: 1947 - DNA, 17 bp, Homo sapiens
tctgcagcgctacaaag

SEQ ID NO: 1948 - DNA, 17 bp, Homo sapiens
ctgcagcgctacaaagc

SEQ ID NO: 1949 - DNA, 17 bp, Homo sapiens
tgcagcgctacaaagct

SEQ ID NO: 1950 - DNA, 17 bp, Homo sapiens
gcagcgctacaaagctc

SEQ ID NO: 1951 - DNA, 17 bp, Homo sapiens
cagcgctacaaagctca

SEQ ID NO: 1952 - DNA, 17 bp, Homo sapiens
agcgctacaaagctcag

SEQ ID NO: 1953 - DNA, 17 bp, Homo sapiens
gcgctacaaagctcagc

SEQ ID NO: 1954 - DNA, 17 bp, Homo sapiens
cgctacaaagctcagct

SEQ ID NO: 1955 - DNA, 17 bp, Homo sapiens
gctacaaagctcagctg

SEQ ID NO: 1956 - DNA, 17 bp, Homo sapiens
ctacaaagctcagctgc

SEQ ID NO: 1957 - DNA, 17 bp, Homo sapiens
tacaaagctcagctgct

SEQ ID NO: 1958 - DNA, 17 bp, Homo sapiens
acaaagctcagctgctg

SEQ ID NO: 1959 - DNA, 17 bp, Homo sapiens
caaagctcagctgctgc

SEQ ID NO: 1960 - DNA, 17 bp, Homo sapiens
aaagctcagctgctgca

SEQ ID NO: 1961 - DNA, 17 bp, Homo sapiens
aagctcagctgctgcac

SEQ ID NO: 1962 - DNA, 17 bp, Homo sapiens
agctcagctgctgcaca

SEQ ID NO: 1963 - DNA, 17 bp, Homo sapiens
gctcagctgctgcacac

SEQ ID NO: 1964 - DNA, 17 bp, Homo sapiens
ctcagctgctgcacacc

SEQ ID NO: 1965 - DNA, 17 bp, Homo sapiens
tcagctgctgcacacct

SEQ ID NO: 1966 - DNA, 17 bp, Homo sapiens
cagctgctgcacacctg

SEQ ID NO: 1967 - DNA, 17 bp, Homo sapiens
agctgctgcacacctgc

SEQ ID NO: 1968 - DNA, 17 bp, Homo sapiens
gctgctgcacacctgca

SEQ ID NO: 1969 - DNA, 17 bp, Homo sapiens
ctgctgcacacctgcac

SEQ ID NO: 1970 - DNA, 17 bp, Homo sapiens
tgctgcacacctgcaca

SEQ ID NO: 1971 - DNA, 17 bp, Homo sapiens
gctgcacacctgcacag

SEQ ID NO: 1972 - DNA, 17 bp, Homo sapiens
ctgcacacctgcacagg

SEQ ID NO: 1973 - DNA, 17 bp, Homo sapiens
tgcacacctgcacaggg

SEQ ID NO: 1974 - DNA, 17 bp, Homo sapiens
gcacacctgcacagggc

SEQ ID NO: 1975 - DNA, 17 bp, Homo sapiens
cacacctgcacagggcc

SEQ ID NO: 1976 - DNA, 17 bp, Homo sapiens
acacctgcacagggcct

SEQ ID NO: 1977 - DNA, 17 bp, Homo sapiens
cacctgcacagggcctg

SEQ ID NO: 1978 - DNA, 17 bp, Homo sapiens
acctgcacagggcctga

SEQ ID NO: 1979 - DNA, 17 bp, Homo sapiens
cctgcacagggcctgat

SEQ ID NO: 1980 - DNA, 17 bp, Homo sapiens
ctgcacagggcctgatc

SEQ ID NO: 1981 - DNA, 17 bp, Homo sapiens
tgcacagggcctgatct

SEQ ID NO: 1982 - DNA, 17 bp, Homo sapiens
gcacagggcctgatctg

SEQ ID NO: 1983 - DNA, 17 bp, Homo sapiens
cacagggcctgatctga

SEQ ID NO: 1984 - DNA, 17 bp, Homo sapiens
acagggcctgatctgat

SEQ ID NO: 1985 - DNA, 17 bp, Homo sapiens
cagggcctgatctgatt

SEQ ID NO: 1986 - DNA, 17 bp, Homo sapiens
agggcctgatctgattg

SEQ ID NO: 1987 - DNA, 17 bp, Homo sapiens
gggcctgatctgattgt

SEQ ID NO: 1988 - DNA, 17 bp, Homo sapiens
ggcctgatctgattgtc

SEQ ID NO: 1989 - DNA, 17 bp, Homo sapiens
gcctgatctgattgtcc

SEQ ID NO: 1990 - DNA, 17 bp, Homo sapiens
cctgatctgattgtcct

SEQ ID NO: 1991 - DNA, 17 bp, Homo sapiens
ctgatctgattgtcctc

SEQ ID NO: 1992 - DNA, 17 bp, Homo sapiens
tgatctgattgtcctcc

SEQ ID NO: 1993 - DNA, 17 bp, Homo sapiens
gatctgattgtcctcca

SEQ ID NO: 1994 - DNA, 17 bp, Homo sapiens
atctgattgtcctccag

SEQ ID NO: 1995 - DNA, 17 bp, Homo sapiens
tctgattgtcctccagc

SEQ ID NO: 1996 - DNA, 17 bp, Homo sapiens
ctgattgtcctccagcc

SEQ ID NO: 1997 - DNA, 17 bp, Homo sapiens
tgattgtcctccagccc

SEQ ID NO: 1998 - DNA, 17 bp, Homo sapiens
gattgtcctccagcccc

SEQ ID NO: 1999 - DNA, 17 bp, Homo sapiens
attgtcctccagccccg

SEQ ID NO: 2000 - DNA, 17 bp, Homo sapiens
ttgtcctccagccccgg

SEQ ID NO: 2001 - DNA, 17 bp, Homo sapiens
tgtcctccagccccggg

SEQ ID NO: 2002 - DNA, 17 bp, Homo sapiens
gtcctccagccccgggg

SEQ ID NO: 2003 - DNA, 17 bp, Homo sapiens
tcctccagccccggggg

SEQ ID NO: 2004 - DNA, 17 bp, Homo sapiens
cctccagccccgggggc

SEQ ID NO: 2005 - DNA, 17 bp, Homo sapiens
ctccagccccgggggcc

SEQ ID NO: 2006 - DNA, 17 bp, Homo sapiens
tccagccccgggggccc

SEQ ID NO: 2007 - DNA, 17 bp, Homo sapiens
ccagccccgggggccct

SEQ ID NO: 2008 - DNA, 17 bp, Homo sapiens
cagccccgggggccctc

SEQ ID NO: 2009 - DNA, 17 bp, Homo sapiens
agccccgggggccctcg

SEQ ID NO: 2010 - DNA, 17 bp, Homo sapiens
gccccgggggccctcgg

SEQ ID NO: 2011 - DNA, 17 bp, Homo sapiens
ccccgggggccctcggt

SEQ ID NO: 2012 - DNA, 17 bp, Homo sapiens
cccgggggccctcggtg

SEQ ID NO: 2013 - DNA, 17 bp, Homo sapiens
ccgggggccctcggtgc

SEQ ID NO: 2014 - DNA, 17 bp, Homo sapiens
cgggggccctcggtgcc

SEQ ID NO: 2015 - DNA, 17 bp, Homo sapiens
gggggccctcggtgcct

SEQ ID NO: 2016 - DNA, 17 bp, Homo sapiens
ggggccctcggtgcctt

SEQ ID NO: 2017 - DNA, 17 bp, Homo sapiens
gggccctcggtgccttc

SEQ ID NO: 2018 - DNA, 17 bp, Homo sapiens
ggccctcggtgccttct

SEQ ID NO: 2019 - DNA, 17 bp, Homo sapiens
gccctcggtgccttctg

SEQ ID NO: 2020 - DNA, 17 bp, Homo sapiens
ccctcggtgccttctgc

SEQ ID NO: 2021 - DNA, 17 bp, Homo sapiens
cctcggtgccttctgca

SEQ ID NO: 2022 - DNA, 17 bp, Homo sapiens
ctcggtgccttctgcag

SEQ ID NO: 2023 - DNA, 17 bp, Homo sapiens
tcggtgccttctgcagg

SEQ ID NO: 2024 - DNA, 17 bp, Homo sapiens
cggtgccttctgcaggg

SEQ ID NO: 2025 - DNA, 17 bp, Homo sapiens
ggtgccttctgcaggga

SEQ ID NO: 2026 - DNA, 17 bp, Homo sapiens
gtgccttctgcagggaa

SEQ ID NO: 2027 - DNA, 17 bp, Homo sapiens
tgccttctgcagggaag

SEQ ID NO: 2028 - DNA, 17 bp, Homo sapiens
gccttctgcagggaagg

SEQ ID NO: 2029 - DNA, 17 bp, Homo sapiens
ccttctgcagggaaggt

SEQ ID NO: 2030 - DNA, 17 bp, Homo sapiens
cttctgcagggaaggtg

SEQ ID NO: 2031 - DNA, 17 bp, Homo sapiens
ttctgcagggaaggtgc

SEQ ID NO: 2032 - DNA, 17 bp, Homo sapiens
tctgcagggaaggtgcc

SEQ ID NO: 2033 - DNA, 17 bp, Homo sapiens
ctgcagggaaggtgccc

SEQ ID NO: 2034 - DNA, 17 bp, Homo sapiens
tgcagggaaggtgccca

SEQ ID NO: 2035 - DNA, 17 bp, Homo sapiens
gcagggaaggtgcccaa

SEQ ID NO: 2036 - DNA, 17 bp, Homo sapiens
cagggaaggtgcccaag

SEQ ID NO: 2037 - DNA, 17 bp, Homo sapiens
agggaaggtgcccaagg

SEQ ID NO: 2038 - DNA, 17 bp, Homo sapiens
gggaaggtgcccaaggg

SEQ ID NO: 2039 - DNA, 17 bp, Homo sapiens
ggaaggtgcccaagggc

SEQ ID NO: 2040 - DNA, 17 bp, Homo sapiens
gaaggtgcccaagggcc

SEQ ID NO: 2041 - DNA, 17 bp, Homo sapiens
aaggtgcccaagggccg

SEQ ID NO: 2042 - DNA, 17 bp, Homo sapiens
aggtgcccaagggccgc

SEQ ID NO: 2043 - DNA, 17 bp, Homo sapiens
ggtgcccaagggccgcc

SEQ ID NO: 2044 - DNA, 17 bp, Homo sapiens
gtgcccaagggccgccg

SEQ ID NO: 2045 - DNA, 17 bp, Homo sapiens
tgcccaagggccgccgg

SEQ ID NO: 2046 - DNA, 17 bp, Homo sapiens
gcccaagggccgccggg

SEQ ID NO: 2047 - DNA, 17 bp, Homo sapiens
cccaagggccgccggga

SEQ ID NO: 2048 - DNA, 17 bp, Homo sapiens
ccaagggccgccgggat

SEQ ID NO: 2049 - DNA, 17 bp, Homo sapiens
caagggccgccgggatg

SEQ ID NO: 2050 - DNA, 17 bp, Homo sapiens
aagggccgccgggatgg

SEQ ID NO: 2051 - DNA, 17 bp, Homo sapiens
agggccgccgggatggc

SEQ ID NO: 2052 - DNA, 17 bp, Homo sapiens
gggccgccgggatggcc

SEQ ID NO: 2053 - DNA, 17 bp, Homo sapiens
ggccgccgggatggcct

SEQ ID NO: 2054 - DNA, 17 bp, Homo sapiens
gccgccgggatggcctg

SEQ ID NO: 2055 - DNA, 17 bp, Homo sapiens
ccgccgggatggcctgc

SEQ ID NO: 2056 - DNA, 17 bp, Homo sapiens
cgccgggatggcctgcc

SEQ ID NO: 2057 - DNA, 17 bp, Homo sapiens
gccgggatggcctgcct

SEQ ID NO: 2058 - DNA, 17 bp, Homo sapiens
ccgggatggcctgcctg

SEQ ID NO: 2059 - DNA, 17 bp, Homo sapiens
cgggatggcctgcctgc

SEQ ID NO: 2060 - DNA, 17 bp, Homo sapiens
gggatggcctgcctgcc

SEQ ID NO: 2061 - DNA, 17 bp, Homo sapiens
ggatggcctgcctgccc

SEQ ID NO: 2062 - DNA, 17 bp, Homo sapiens
gatggcctgcctgccca

SEQ ID NO: 2063 - DNA, 17 bp, Homo sapiens
atggcctgcctgcccac

SEQ ID NO: 2064 - DNA, 17 bp, Homo sapiens
tggcctgcctgcccaca

SEQ ID NO: 2065 - DNA, 17 bp, Homo sapiens
ggcctgcctgcccacat

SEQ ID NO: 2066 - DNA, 17 bp, Homo sapiens
gcctgcctgcccacatt

SEQ ID NO: 2067 - DNA, 17 bp, Homo sapiens
cctgcctgcccacattg

SEQ ID NO: 2068 - DNA, 17 bp, Homo sapiens
ctgcctgcccacattgg

SEQ ID NO: 2069 - DNA, 17 bp, Homo sapiens
tgcctgcccacattggc

SEQ ID NO: 2070 - DNA, 17 bp, Homo sapiens
gcctgcccacattggct

SEQ ID NO: 2071 - DNA, 17 bp, Homo sapiens
cctgcccacattggctc

SEQ ID NO: 2072 - DNA, 17 bp, Homo sapiens
ctgcccacattggctcc

SEQ ID NO: 2073 - DNA, 17 bp, Homo sapiens
tgcccacattggctcca

SEQ ID NO: 2074 - DNA, 17 bp, Homo sapiens
gcccacattggctccat

SEQ ID NO: 2075 - DNA, 17 bp, Homo sapiens
cccacattggctccatg

SEQ ID NO: 2076 - DNA, 17 bp, Homo sapiens
ccacattggctccatgg

SEQ ID NO: 2077 - DNA, 17 bp, Homo sapiens
cacattggctccatggc

SEQ ID NO: 2078 - DNA, 17 bp, Homo sapiens
acattggctccatggca

SEQ ID NO: 2079 - DNA, 17 bp, Homo sapiens
cattggctccatggcac

SEQ ID NO: 2080 - DNA, 17 bp, Homo sapiens
attggctccatggcaca

SEQ ID NO: 2081 - DNA, 17 bp, Homo sapiens
ttggctccatggcacag

SEQ ID NO: 2082 - DNA, 17 bp, Homo sapiens
tggctccatggcacagc

SEQ ID NO: 2083 - DNA, 17 bp, Homo sapiens
ggctccatggcacagcg

SEQ ID NO: 2084 - DNA, 17 bp, Homo sapiens
gctccatggcacagcgg

SEQ ID NO: 2085 - DNA, 17 bp, Homo sapiens
ctccatggcacagcggg

SEQ ID NO: 2086 - DNA, 17 bp, Homo sapiens
tccatggcacagcgggc

SEQ ID NO: 2087 - DNA, 17 bp, Homo sapiens
ccatggcacagcgggca

SEQ ID NO: 2088 - DNA, 17 bp, Homo sapiens
catggcacagcgggcat

SEQ ID NO: 2089 - DNA, 17 bp, Homo sapiens
atggcacagcgggcata

SEQ ID NO: 2090 - DNA, 17 bp, Homo sapiens
tggcacagcgggcatac

SEQ ID NO: 2091 - DNA, 17 bp, Homo sapiens
ggcacagcgggcatact

SEQ ID NO: 2092 - DNA, 17 bp, Homo sapiens
gcacagcgggcatactg

SEQ ID NO: 2093 - DNA, 17 bp, Homo sapiens
cacagcgggcatactgg

SEQ ID NO: 2094 - DNA, 17 bp, Homo sapiens
acagcgggcatactggg

SEQ ID NO: 2095 - DNA, 17 bp, Homo sapiens
cagcgggcatactgggc

SEQ ID NO: 2096 - DNA, 17 bp, Homo sapiens
agcgggcatactgggcg

SEQ ID NO: 2097 - DNA, 17 bp, Homo sapiens
gcgggcatactgggcgc

SEQ ID NO: 2098 - DNA, 17 bp, Homo sapiens
cgggcatactgggcgct

SEQ ID NO: 2099 - DNA, 17 bp, Homo sapiens
gggcatactgggcgctg

SEQ ID NO: 2100 - DNA, 17 bp, Homo sapiens
ggcatactgggcgctgc

SEQ ID NO: 2101 - DNA, 17 bp, Homo sapiens
gcatactgggcgctgct

SEQ ID NO: 2102 - DNA, 17 bp, Homo sapiens
catactgggcgctgctg

SEQ ID NO: 2103 - DNA, 17 bp, Homo sapiens
atactgggcgctgctga

SEQ ID NO: 2104 - DNA, 17 bp, Homo sapiens
tactgggcgctgctgaa

SEQ ID NO: 2105 - DNA, 17 bp, Homo sapiens
actgggcgctgctgaac

SEQ ID NO: 2106 - DNA, 17 bp, Homo sapiens
ctgggcgctgctgaacc

SEQ ID NO: 2107 - DNA, 17 bp, Homo sapiens
tgggcgctgctgaacca

SEQ ID NO: 2108 - DNA, 17 bp, Homo sapiens
gggcgctgctgaaccag

SEQ ID NO: 2109 - DNA, 17 bp, Homo sapiens
ggcgctgctgaaccagc

SEQ ID NO: 2110 - DNA, 17 bp, Homo sapiens
gcgctgctgaaccagcg

SEQ ID NO: 2111 - DNA, 17 bp, Homo sapiens
cgctgctgaaccagcgg

SEQ ID NO: 2112 - DNA, 17 bp, Homo sapiens
gctgctgaaccagcgga

SEQ ID NO: 2113 - DNA, 17 bp, Homo sapiens
ctgctgaaccagcggag

SEQ ID NO: 2114 - DNA, 17 bp, Homo sapiens
tgctgaaccagcggaga

SEQ ID NO: 2115 - DNA, 17 bp, Homo sapiens
gctgaaccagcggagag

SEQ ID NO: 2116 - DNA, 17 bp, Homo sapiens
ctgaaccagcggagaga

SEQ ID NO: 2117 - DNA, 17 bp, Homo sapiens
tgaaccagcggagagac

SEQ ID NO: 2118 - DNA, 17 bp, Homo sapiens
gaaccagcggagagacc

SEQ ID NO: 2119 - DNA, 17 bp, Homo sapiens
aaccagcggagagacca

SEQ ID NO: 2120 - DNA, 17 bp, Homo sapiens
accagcggagagaccag

SEQ ID NO: 2121 - DNA, 17 bp, Homo sapiens
ccagcggagagaccaga

SEQ ID NO: 2122 - DNA, 17 bp, Homo sapiens
cagcggagagaccagag

SEQ ID NO: 2123 - DNA, 17 bp, Homo sapiens
agcggagagaccagagc

SEQ ID NO: 2124 - DNA, 17 bp, Homo sapiens
gcggagagaccagagca

SEQ ID NO: 2125 - DNA, 17 bp, Homo sapiens
cggagagaccagagcat

SEQ ID NO: 2126 - DNA, 17 bp, Homo sapiens
ggagagaccagagcatt

SEQ ID NO: 2127 - DNA, 17 bp, Homo sapiens
gagagaccagagcattg

SEQ ID NO: 2128 - DNA, 17 bp, Homo sapiens
agagaccagagcattgt

SEQ ID NO: 2129 - DNA, 17 bp, Homo sapiens
gagaccagagcattgtg

SEQ ID NO: 2130 - DNA, 17 bp, Homo sapiens
agaccagagcattgtgg

SEQ ID NO: 2131 - DNA, 17 bp, Homo sapiens
gaccagagcattgtggc

SEQ ID NO: 2132 - DNA, 17 bp, Homo sapiens
accagagcattgtggcc

SEQ ID NO: 2133 - DNA, 17 bp, Homo sapiens
ccagagcattgtggccc

SEQ ID NO: 2134 - DNA, 17 bp, Homo sapiens
cagagcattgtggccct

SEQ ID NO: 2135 - DNA, 17 bp, Homo sapiens
agagcattgtggccctg

SEQ ID NO: 2136 - DNA, 17 bp, Homo sapiens
gagcattgtggccctgg

SEQ ID NO: 2137 - DNA, 17 bp, Homo sapiens
agcattgtggccctggg

SEQ ID NO: 2138 - DNA, 17 bp, Homo sapiens
gcattgtggccctgggc

SEQ ID NO: 2139 - DNA, 17 bp, Homo sapiens
cattgtggccctgggcc

SEQ ID NO: 2140 - DNA, 17 bp, Homo sapiens
attgtggccctgggccg

SEQ ID NO: 2141 - DNA, 17 bp, Homo sapiens
ttgtggccctgggccgg

SEQ ID NO: 2142 - DNA, 17 bp, Homo sapiens
tgtggccctgggccgga

SEQ ID NO: 2143 - DNA, 17 bp, Homo sapiens
gtggccctgggccggag

SEQ ID NO: 2144 - DNA, 17 bp, Homo sapiens
tggccctgggccggagt

SEQ ID NO: 2145 - DNA, 17 bp, Homo sapiens
ggccctgggccggagtg

SEQ ID NO: 2146 - DNA, 17 bp, Homo sapiens
gccctgggccggagtgg

SEQ ID NO: 2147 - DNA, 17 bp, Homo sapiens
ccctgggccggagtggc

SEQ ID NO: 2148 - DNA, 17 bp, Homo sapiens
cctgggccggagtggcg

SEQ ID NO: 2149 - DNA, 17 bp, Homo sapiens
ctgggccggagtggcgc

SEQ ID NO: 2150 - DNA, 17 bp, Homo sapiens
tgggccggagtggcgct

SEQ ID NO: 2151 - DNA, 17 bp, Homo sapiens
gggccggagtggcgctg

SEQ ID NO: 2152 - DNA, 17 bp, Homo sapiens
ggccggagtggcgctgg

SEQ ID NO: 2153 - DNA, 17 bp, Homo sapiens
gccggagtggcgctggg

SEQ ID NO: 2154 - DNA, 17 bp, Homo sapiens
ccggagtggcgctggga

SEQ ID NO: 2155 - DNA, 17 bp, Homo sapiens
cggagtggcgctgggaa

SEQ ID NO: 2156 - DNA, 17 bp, Homo sapiens
ggagtggcgctgggaag

SEQ ID NO: 2157 - DNA, 17 bp, Homo sapiens
gagtggcgctgggaaga

SEQ ID NO: 2158 - DNA, 17 bp, Homo sapiens
agtggcgctgggaagac

SEQ ID NO: 2159 - DNA, 17 bp, Homo sapiens
gtggcgctgggaagacc

SEQ ID NO: 2160 - DNA, 17 bp, Homo sapiens
tggcgctgggaagacca

SEQ ID NO: 2161 - DNA, 17 bp, Homo sapiens
ggcgctgggaagaccac

SEQ ID NO: 2162 - DNA, 17 bp, Homo sapiens
gcgctgggaagaccacc

SEQ ID NO: 2163 - DNA, 17 bp, Homo sapiens
cgctgggaagaccacct

SEQ ID NO: 2164 - DNA, 17 bp, Homo sapiens
gctgggaagaccacctg

SEQ ID NO: 2165 - DNA, 17 bp, Homo sapiens
ctgggaagaccacctgc

SEQ ID NO: 2166 - DNA, 17 bp, Homo sapiens
tgggaagaccacctgct

SEQ ID NO: 2167 - DNA, 17 bp, Homo sapiens
gggaagaccacctgctg

SEQ ID NO: 2168 - DNA, 17 bp, Homo sapiens
ggaagaccacctgctgt

SEQ ID NO: 2169 - DNA, 17 bp, Homo sapiens
gaagaccacctgctgtg

SEQ ID NO: 2170 - DNA, 17 bp, Homo sapiens
aagaccacctgctgtga

SEQ ID NO: 2171 - DNA, 17 bp, Homo sapiens
agaccacctgctgtgag

SEQ ID NO: 2172 - DNA, 17 bp, Homo sapiens
gaccacctgctgtgagc

SEQ ID NO: 2173 - DNA, 17 bp, Homo sapiens
accacctgctgtgagca

SEQ ID NO: 2174 - DNA, 17 bp, Homo sapiens
ccacctgctgtgagcag

SEQ ID NO: 2175 - DNA, 17 bp, Homo sapiens
cacctgctgtgagcagg

SEQ ID NO: 2176 - DNA, 17 bp, Homo sapiens
acctgctgtgagcaggt

SEQ ID NO: 2177 - DNA, 17 bp, Homo sapiens
cctgctgtgagcaggtc

SEQ ID NO: 2178 - DNA, 17 bp, Homo sapiens
ctgctgtgagcaggtcc

SEQ ID NO: 2179 - DNA, 17 bp, Homo sapiens
tgctgtgagcaggtcct

SEQ ID NO: 2180 - DNA, 17 bp, Homo sapiens
gctgtgagcaggtcctg

SEQ ID NO: 2181 - DNA, 17 bp, Homo sapiens
ctgtgagcaggtcctgg

SEQ ID NO: 2182 - DNA, 17 bp, Homo sapiens
tgtgagcaggtcctgga

SEQ ID NO: 2183 - DNA, 17 bp, Homo sapiens
gtgagcaggtcctggaa

SEQ ID NO: 2184 - DNA, 17 bp, Homo sapiens
tgagcaggtcctggaac

SEQ ID NO: 2185 - DNA, 17 bp, Homo sapiens
gagcaggtcctggaaca

SEQ ID NO: 2186 - DNA, 17 bp, Homo sapiens
agcaggtcctggaacac

SEQ ID NO: 2187 - DNA, 17 bp, Homo sapiens
gcaggtcctggaacacc

SEQ ID NO: 2188 - DNA, 17 bp, Homo sapiens
caggtcctggaacacct

SEQ ID NO: 2189 - DNA, 17 bp, Homo sapiens
aggtcctggaacacctg

SEQ ID NO: 2190 - DNA, 17 bp, Homo sapiens
ggtcctggaacacctgg

SEQ ID NO: 2191 - DNA, 17 bp, Homo sapiens
gtcctggaacacctggt

SEQ ID NO: 2192 - DNA, 17 bp, Homo sapiens
tcctggaacacctggtg

SEQ ID NO: 2193 - DNA, 17 bp, Homo sapiens
cctggaacacctggtgg

SEQ ID NO: 2194 - DNA, 17 bp, Homo sapiens
ctggaacacctggtggg

SEQ ID NO: 2195 - DNA, 17 bp, Homo sapiens
tggaacacctggtgggg

SEQ ID NO: 2196 - DNA, 17 bp, Homo sapiens
ggaacacctggtgggga

SEQ ID NO: 2197 - DNA, 17 bp, Homo sapiens
gaacacctggtggggat

SEQ ID NO: 2198 - DNA, 17 bp, Homo sapiens
aacacctggtggggatg

SEQ ID NO: 2199 - DNA, 17 bp, Homo sapiens
acacctggtggggatgg

SEQ ID NO: 2200 - DNA, 17 bp, Homo sapiens
cacctggtggggatggc

SEQ ID NO: 2201 - DNA, 17 bp, Homo sapiens
acctggtggggatggca

SEQ ID NO: 2202 - DNA, 17 bp, Homo sapiens
cctggtggggatggcag

SEQ ID NO: 2203 - DNA, 17 bp, Homo sapiens
ctggtggggatggcagg

SEQ ID NO: 2204 - DNA, 17 bp, Homo sapiens
tggtggggatggcaggc

SEQ ID NO: 2205 - DNA, 17 bp, Homo sapiens
ggtggggatggcaggca

SEQ ID NO: 2206 - DNA, 17 bp, Homo sapiens
gtggggatggcaggcag

SEQ ID NO: 2207 - DNA, 17 bp, Homo sapiens
tggggatggcaggcagt

SEQ ID NO: 2208 - DNA, 17 bp, Homo sapiens
ggggatggcaggcagtg

SEQ ID NO: 2209 - DNA, 17 bp, Homo sapiens
gggatggcaggcagtgt

SEQ ID NO: 2210 - DNA, 17 bp, Homo sapiens
ggatggcaggcagtgtg

SEQ ID NO: 2211 - DNA, 17 bp, Homo sapiens
gatggcaggcagtgtgg

SEQ ID NO: 2212 - DNA, 17 bp, Homo sapiens
atggcaggcagtgtgga

SEQ ID NO: 2213 - DNA, 17 bp, Homo sapiens
tggcaggcagtgtggat

SEQ ID NO: 2214 - DNA, 17 bp, Homo sapiens
ggcaggcagtgtggatg

SEQ ID NO: 2215 - DNA, 17 bp, Homo sapiens
gcaggcagtgtggatgg

SEQ ID NO: 2216 - DNA, 17 bp, Homo sapiens
caggcagtgtggatggc

SEQ ID NO: 2217 - DNA, 17 bp, Homo sapiens
aggcagtgtggatggca

SEQ ID NO: 2218 - DNA, 17 bp, Homo sapiens
ggcagtgtggatggcag

SEQ ID NO: 2219 - DNA, 17 bp, Homo sapiens
gcagtgtggatggcagg

SEQ ID NO: 2220 - DNA, 17 bp, Homo sapiens
cagtgtggatggcaggg

SEQ ID NO: 2221 - DNA, 17 bp, Homo sapiens
agtgtggatggcagggt

SEQ ID NO: 2222 - DNA, 17 bp, Homo sapiens
gtgtggatggcagggtc

SEQ ID NO: 2223 - DNA, 17 bp, Homo sapiens
tgtggatggcagggtct

SEQ ID NO: 2224 - DNA, 17 bp, Homo sapiens
gtggatggcagggtctc

SEQ ID NO: 2225 - DNA, 17 bp, Homo sapiens
tggatggcagggtctca

SEQ ID NO: 2226 - DNA, 17 bp, Homo sapiens
ggatggcagggtctcag

SEQ ID NO: 2227 - DNA, 17 bp, Homo sapiens
gatggcagggtctcagt

SEQ ID NO: 2228 - DNA, 17 bp, Homo sapiens
atggcagggtctcagtg

SEQ ID NO: 2229 - DNA, 17 bp, Homo sapiens
tggcagggtctcagtgg

SEQ ID NO: 2230 - DNA, 17 bp, Homo sapiens
ggcagggtctcagtgga

SEQ ID NO: 2231 - DNA, 17 bp, Homo sapiens
gcagggtctcagtggag

SEQ ID NO: 2232 - DNA, 17 bp, Homo sapiens
cagggtctcagtggaga

SEQ ID NO: 2233 - DNA, 17 bp, Homo sapiens
agggtctcagtggagaa

SEQ ID NO: 2234 - DNA, 17 bp, Homo sapiens
gggtctcagtggagaag

SEQ ID NO: 2235 - DNA, 17 bp, Homo sapiens
ggtctcagtggagaaga

SEQ ID NO: 2236 - DNA, 17 bp, Homo sapiens
gtctcagtggagaagat

SEQ ID NO: 2237 - DNA, 17 bp, Homo sapiens
tctcagtggagaagatc

SEQ ID NO: 2238 - DNA, 17 bp, Homo sapiens
ctcagtggagaagatcc

SEQ ID NO: 2239 - DNA, 17 bp, Homo sapiens
tcagtggagaagatccg

SEQ ID NO: 2240 - DNA, 17 bp, Homo sapiens
cagtggagaagatccga

SEQ ID NO: 2241 - DNA, 17 bp, Homo sapiens
agtggagaagatccgag

SEQ ID NO: 2242 - DNA, 17 bp, Homo sapiens
gtggagaagatccgagc

SEQ ID NO: 2243 - DNA, 17 bp, Homo sapiens
tggagaagatccgagcc

SEQ ID NO: 2244 - DNA, 17 bp, Homo sapiens
ggagaagatccgagcca

SEQ ID NO: 2245 - DNA, 17 bp, Homo sapiens
gagaagatccgagccac

SEQ ID NO: 2246 - DNA, 17 bp, Homo sapiens
agaagatccgagccacc

SEQ ID NO: 2247 - DNA, 17 bp, Homo sapiens
gaagatccgagccacct

SEQ ID NO: 2248 - DNA, 17 bp, Homo sapiens
aagatccgagccacctt

SEQ ID NO: 2249 - DNA, 17 bp, Homo sapiens
agatccgagccaccttc

SEQ ID NO: 2250 - DNA, 17 bp, Homo sapiens
gatccgagccaccttca

SEQ ID NO: 2251 - DNA, 17 bp, Homo sapiens
atccgagccaccttcac

SEQ ID NO: 2252 - DNA, 17 bp, Homo sapiens
tccgagccaccttcact

SEQ ID NO: 2253 - DNA, 17 bp, Homo sapiens
ccgagccaccttcactg

SEQ ID NO: 2254 - DNA, 17 bp, Homo sapiens
cgagccaccttcactgt

SEQ ID NO: 2255 - DNA, 17 bp, Homo sapiens
gagccaccttcactgtc

SEQ ID NO: 2256 - DNA, 17 bp, Homo sapiens
agccaccttcactgtcc

SEQ ID NO: 2257 - DNA, 17 bp, Homo sapiens
gccaccttcactgtcct

SEQ ID NO: 2258 - DNA, 17 bp, Homo sapiens
ccaccttcactgtcctc

SEQ ID NO: 2259 - DNA, 17 bp, Homo sapiens
caccttcactgtcctcc

SEQ ID NO: 2260 - DNA, 17 bp, Homo sapiens
accttcactgtcctccg

SEQ ID NO: 2261 - DNA, 17 bp, Homo sapiens
ccttcactgtcctccgg

SEQ ID NO: 2262 - DNA, 17 bp, Homo sapiens
cttcactgtcctccggg

SEQ ID NO: 2263 - DNA, 17 bp, Homo sapiens
ttcactgtcctccgggc

SEQ ID NO: 2264 - DNA, 17 bp, Homo sapiens
tcactgtcctccgggcc

SEQ ID NO: 2265 - DNA, 17 bp, Homo sapiens
cactgtcctccgggcct

SEQ ID NO: 2266 - DNA, 17 bp, Homo sapiens
actgtcctccgggcctt

SEQ ID NO: 2267 - DNA, 17 bp, Homo sapiens
ctgtcctccgggccttc

SEQ ID NO: 2268 - DNA, 17 bp, Homo sapiens
tgtcctccgggccttcg

SEQ ID NO: 2269 - DNA, 17 bp, Homo sapiens
gtcctccgggccttcgg

SEQ ID NO: 2270 - DNA, 17 bp, Homo sapiens
tcctccgggccttcggc

SEQ ID NO: 2271 - DNA, 17 bp, Homo sapiens
cctccgggccttcggct

SEQ ID NO: 2272 - DNA, 17 bp, Homo sapiens
ctccgggccttcggctc

SEQ ID NO: 2273 - DNA, 17 bp, Homo sapiens
tccgggccttcggctct

SEQ ID NO: 2274 - DNA, 17 bp, Homo sapiens
ccgggccttcggctctg

SEQ ID NO: 2275 - DNA, 17 bp, Homo sapiens
cgggccttcggctctgt

SEQ ID NO: 2276 - DNA, 17 bp, Homo sapiens
gggccttcggctctgtg

SEQ ID NO: 2277 - DNA, 17 bp, Homo sapiens
ggccttcggctctgtgt

SEQ ID NO: 2278 - DNA, 17 bp, Homo sapiens
gccttcggctctgtgtc

SEQ ID NO: 2279 - DNA, 17 bp, Homo sapiens
ccttcggctctgtgtcc

SEQ ID NO: 2280 - DNA, 17 bp, Homo sapiens
cttcggctctgtgtcca

SEQ ID NO: 2281 - DNA, 17 bp, Homo sapiens
ttcggctctgtgtccat

SEQ ID NO: 2282 - DNA, 17 bp, Homo sapiens
tcggctctgtgtccatg

SEQ ID NO: 2283 - DNA, 17 bp, Homo sapiens
cggctctgtgtccatgg

SEQ ID NO: 2284 - DNA, 17 bp, Homo sapiens
ggctctgtgtccatggc

SEQ ID NO: 2285 - DNA, 17 bp, Homo sapiens
gctctgtgtccatggcc

SEQ ID NO: 2286 - DNA, 17 bp, Homo sapiens
ctctgtgtccatggccc

SEQ ID NO: 2287 - DNA, 17 bp, Homo sapiens
tctgtgtccatggccca

SEQ ID NO: 2288 - DNA, 17 bp, Homo sapiens
ctgtgtccatggcccac

SEQ ID NO: 2289 - DNA, 17 bp, Homo sapiens
tgtgtccatggcccaca

SEQ ID NO: 2290 - DNA, 17 bp, Homo sapiens
gtgtccatggcccacag

SEQ ID NO: 2291 - DNA, 17 bp, Homo sapiens
tgtccatggcccacagc

SEQ ID NO: 2292 - DNA, 17 bp, Homo sapiens
gtccatggcccacagcc

SEQ ID NO: 2293 - DNA, 17 bp, Homo sapiens
tccatggcccacagccg

SEQ ID NO: 2294 - DNA, 17 bp, Homo sapiens
ccatggcccacagccgc

SEQ ID NO: 2295 - DNA, 17 bp, Homo sapiens
catggcccacagccgca

SEQ ID NO: 2296 - DNA, 17 bp, Homo sapiens
atggcccacagccgcag

SEQ ID NO: 2297 - DNA, 17 bp, Homo sapiens
tggcccacagccgcagt

SEQ ID NO: 2298 - DNA, 17 bp, Homo sapiens
ggcccacagccgcagtg

SEQ ID NO: 2299 - DNA, 17 bp, Homo sapiens
gcccacagccgcagtgc

SEQ ID NO: 2300 - DNA, 17 bp, Homo sapiens
cccacagccgcagtgcc

SEQ ID NO: 2301 - DNA, 17 bp, Homo sapiens
ccacagccgcagtgcca

SEQ ID NO: 2302 - DNA, 17 bp, Homo sapiens
cacagccgcagtgccac

SEQ ID NO: 2303 - DNA, 17 bp, Homo sapiens
acagccgcagtgccacc

SEQ ID NO: 2304 - DNA, 17 bp, Homo sapiens
cagccgcagtgccaccc

SEQ ID NO: 2305 - DNA, 17 bp, Homo sapiens
agccgcagtgccacccg

SEQ ID NO: 2306 - DNA, 17 bp, Homo sapiens
gccgcagtgccacccgg

SEQ ID NO: 2307 - DNA, 17 bp, Homo sapiens
ccgcagtgccacccggt

SEQ ID NO: 2308 - DNA, 17 bp, Homo sapiens
cgcagtgccacccggtt

SEQ ID NO: 2309 - DNA, 17 bp, Homo sapiens
gcagtgccacccggttc

SEQ ID NO: 2310 - DNA, 17 bp, Homo sapiens
cagtgccacccggttct

SEQ ID NO: 2311 - DNA, 17 bp, Homo sapiens
agtgccacccggttctc

SEQ ID NO: 2312 - DNA, 17 bp, Homo sapiens
gtgccacccggttctcc

SEQ ID NO: 2313 - DNA, 17 bp, Homo sapiens
tgccacccggttctcca

SEQ ID NO: 2314 - DNA, 17 bp, Homo sapiens
gccacccggttctccat

SEQ ID NO: 2315 - DNA, 17 bp, Homo sapiens
ccacccggttctccatg

SEQ ID NO: 2316 - DNA, 17 bp, Homo sapiens
cacccggttctccatgg

SEQ ID NO: 2317 - DNA, 17 bp, Homo sapiens
acccggttctccatggt

SEQ ID NO: 2318 - DNA, 17 bp, Homo sapiens
cccggttctccatggtg

SEQ ID NO: 2319 - DNA, 17 bp, Homo sapiens
ccggttctccatggtga

SEQ ID NO: 2320 - DNA, 17 bp, Homo sapiens
cggttctccatggtgat

SEQ ID NO: 2321 - DNA, 17 bp, Homo sapiens
ggttctccatggtgatg

SEQ ID NO: 2322 - DNA, 17 bp, Homo sapiens
gttctccatggtgatgt

SEQ ID NO: 2323 - DNA, 17 bp, Homo sapiens
ttctccatggtgatgtc

SEQ ID NO: 2324 - DNA, 17 bp, Homo sapiens
tctccatggtgatgtcg

SEQ ID NO: 2325 - DNA, 17 bp, Homo sapiens
ctccatggtgatgtcgc

SEQ ID NO: 2326 - DNA, 17 bp, Homo sapiens
tccatggtgatgtcgct

SEQ ID NO: 2327 - DNA, 17 bp, Homo sapiens
ccatggtgatgtcgctg

SEQ ID NO: 2328 - DNA, 17 bp, Homo sapiens
catggtgatgtcgctgg

SEQ ID NO: 2329 - DNA, 17 bp, Homo sapiens
atggtgatgtcgctgga

SEQ ID NO: 2330 - DNA, 17 bp, Homo sapiens
tggtgatgtcgctggac

SEQ ID NO: 2331 - DNA, 17 bp, Homo sapiens
ggtgatgtcgctggact

SEQ ID NO: 2332 - DNA, 17 bp, Homo sapiens
gtgatgtcgctggactt

SEQ ID NO: 2333 - DNA, 17 bp, Homo sapiens
tgatgtcgctggacttc

SEQ ID NO: 2334 - DNA, 17 bp, Homo sapiens
gatgtcgctggacttca

SEQ ID NO: 2335 - DNA, 17 bp, Homo sapiens
atgtcgctggacttcaa

SEQ ID NO: 2336 - DNA, 17 bp, Homo sapiens
tgtcgctggacttcaac

SEQ ID NO: 2337 - DNA, 17 bp, Homo sapiens
gtcgctggacttcaacg

SEQ ID NO: 2338 - DNA, 17 bp, Homo sapiens
tcgctggacttcaacgc

SEQ ID NO: 2339 - DNA, 17 bp, Homo sapiens
cgctggacttcaacgct

SEQ ID NO: 2340 - DNA, 17 bp, Homo sapiens
gctggacttcaacgcta

SEQ ID NO: 2341 - DNA, 17 bp, Homo sapiens
ctggacttcaacgctac

SEQ ID NO: 2342 - DNA, 17 bp, Homo sapiens
tggacttcaacgctaca

SEQ ID NO: 2343 - DNA, 17 bp, Homo sapiens
ggacttcaacgctacag

SEQ ID NO: 2344 - DNA, 17 bp, Homo sapiens
gacttcaacgctacagg

SEQ ID NO: 2345 - DNA, 17 bp, Homo sapiens
acttcaacgctacaggc

SEQ ID NO: 2346 - DNA, 17 bp, Homo sapiens
cttcaacgctacaggcc

SEQ ID NO: 2347 - DNA, 17 bp, Homo sapiens
ttcaacgctacaggccg

SEQ ID NO: 2348 - DNA, 17 bp, Homo sapiens
tcaacgctacaggccgc

SEQ ID NO: 2349 - DNA, 17 bp, Homo sapiens
caacgctacaggccgca

SEQ ID NO: 2350 - DNA, 17 bp, Homo sapiens
aacgctacaggccgcat

SEQ ID NO: 2351 - DNA, 17 bp, Homo sapiens
acgctacaggccgcatc

SEQ ID NO: 2352 - DNA, 17 bp, Homo sapiens
cgctacaggccgcatca

SEQ ID NO: 2353 - DNA, 17 bp, Homo sapiens
gctacaggccgcatcac

SEQ ID NO: 2354 - DNA, 17 bp, Homo sapiens
ctacaggccgcatcaca

SEQ ID NO: 2355 - DNA, 17 bp, Homo sapiens
tacaggccgcatcacag

SEQ ID NO: 2356 - DNA, 17 bp, Homo sapiens
acaggccgcatcacagc

SEQ ID NO: 2357 - DNA, 17 bp, Homo sapiens
caggccgcatcacagct

SEQ ID NO: 2358 - DNA, 17 bp, Homo sapiens
aggccgcatcacagctg

SEQ ID NO: 2359 - DNA, 17 bp, Homo sapiens
ggccgcatcacagctgc

SEQ ID NO: 2360 - DNA, 17 bp, Homo sapiens
gccgcatcacagctgct

SEQ ID NO: 2361 - DNA, 17 bp, Homo sapiens
ccgcatcacagctgctc

SEQ ID NO: 2362 - DNA, 17 bp, Homo sapiens
cgcatcacagctgctca

SEQ ID NO: 2363 - DNA, 17 bp, Homo sapiens
gcatcacagctgctcag

SEQ ID NO: 2364 - DNA, 17 bp, Homo sapiens
catcacagctgctcagc

SEQ ID NO: 2365 - DNA, 17 bp, Homo sapiens
atcacagctgctcagct

SEQ ID NO: 2366 - DNA, 17 bp, Homo sapiens
tcacagctgctcagctc

SEQ ID NO: 2367 - DNA, 17 bp, Homo sapiens
cacagctgctcagctcc

SEQ ID NO: 2368 - DNA, 17 bp, Homo sapiens
acagctgctcagctcca

SEQ ID NO: 2369 - DNA, 17 bp, Homo sapiens
cagctgctcagctccag

SEQ ID NO: 2370 - DNA, 17 bp, Homo sapiens
agctgctcagctccaga

SEQ ID NO: 2371 - DNA, 17 bp, Homo sapiens
gctgctcagctccagac

SEQ ID NO: 2372 - DNA, 17 bp, Homo sapiens
ctgctcagctccagaca

SEQ ID NO: 2373 - DNA, 17 bp, Homo sapiens
tgctcagctccagacaa

SEQ ID NO: 2374 - DNA, 17 bp, Homo sapiens
gctcagctccagacaat

SEQ ID NO: 2375 - DNA, 17 bp, Homo sapiens
ctcagctccagacaatg

SEQ ID NO: 2376 - DNA, 17 bp, Homo sapiens
tcagctccagacaatgc

SEQ ID NO: 2377 - DNA, 17 bp, Homo sapiens
cagctccagacaatgct

SEQ ID NO: 2378 - DNA, 17 bp, Homo sapiens
agctccagacaatgctt

SEQ ID NO: 2379 - DNA, 17 bp, Homo sapiens
gctccagacaatgcttt

SEQ ID NO: 2380 - DNA, 17 bp, Homo sapiens
ctccagacaatgctttt

SEQ ID NO: 2381 - DNA, 17 bp, Homo sapiens
tccagacaatgcttttg

SEQ ID NO: 2382 - DNA, 17 bp, Homo sapiens
ccagacaatgcttttgg

SEQ ID NO: 2383 - DNA, 17 bp, Homo sapiens
cagacaatgcttttgga

SEQ ID NO: 2384 - DNA, 17 bp, Homo sapiens
agacaatgcttttggag

SEQ ID NO: 2385 - DNA, 17 bp, Homo sapiens
gacaatgcttttggaga

SEQ ID NO: 2386 - DNA, 17 bp, Homo sapiens
acaatgcttttggagaa

SEQ ID NO: 2387 - DNA, 17 bp, Homo sapiens
caatgcttttggagaag

SEQ ID NO: 2388 - DNA, 17 bp, Homo sapiens
aatgcttttggagaaga

SEQ ID NO: 2389 - DNA, 17 bp, Homo sapiens
atgcttttggagaagag

SEQ ID NO: 2390 - DNA, 17 bp, Homo sapiens
tgcttttggagaagagc

SEQ ID NO: 2391 - DNA, 17 bp, Homo sapiens
gcttttggagaagagcc

SEQ ID NO: 2392 - DNA, 17 bp, Homo sapiens
cttttggagaagagccg

SEQ ID NO: 2393 - DNA, 17 bp, Homo sapiens
ttttggagaagagccgc

SEQ ID NO: 2394 - DNA, 17 bp, Homo sapiens
tttggagaagagccgcg

SEQ ID NO: 2395 - DNA, 17 bp, Homo sapiens
ttggagaagagccgcgt

SEQ ID NO: 2396 - DNA, 17 bp, Homo sapiens
tggagaagagccgcgtg

SEQ ID NO: 2397 - DNA, 17 bp, Homo sapiens
ggagaagagccgcgtgg

SEQ ID NO: 2398 - DNA, 17 bp, Homo sapiens
gagaagagccgcgtggc

SEQ ID NO: 2399 - DNA, 17 bp, Homo sapiens
agaagagccgcgtggca

SEQ ID NO: 2400 - DNA, 17 bp, Homo sapiens
gaagagccgcgtggcac

SEQ ID NO: 2401 - DNA, 17 bp, Homo sapiens
aagagccgcgtggcacg

SEQ ID NO: 2402 - DNA, 17 bp, Homo sapiens
agagccgcgtggcacgg

SEQ ID NO: 2403 - DNA, 17 bp, Homo sapiens
gagccgcgtggcacggc

SEQ ID NO: 2404 - DNA, 17 bp, Homo sapiens
agccgcgtggcacggca

SEQ ID NO: 2405 - DNA, 17 bp, Homo sapiens
gccgcgtggcacggcag

SEQ ID NO: 2406 - DNA, 17 bp, Homo sapiens
ccgcgtggcacggcagc

SEQ ID NO: 2407 - DNA, 17 bp, Homo sapiens
cgcgtggcacggcagcc

SEQ ID NO: 2408 - DNA, 17 bp, Homo sapiens
gcgtggcacggcagccg

SEQ ID NO: 2409 - DNA, 17 bp, Homo sapiens
cgtggcacggcagccgg

SEQ ID NO: 2410 - DNA, 17 bp, Homo sapiens
gtggcacggcagccgga

SEQ ID NO: 2411 - DNA, 17 bp, Homo sapiens
tggcacggcagccggaa

SEQ ID NO: 2412 - DNA, 17 bp, Homo sapiens
ggcacggcagccggaag

SEQ ID NO: 2413 - DNA, 17 bp, Homo sapiens
gcacggcagccggaagg

SEQ ID NO: 2414 - DNA, 17 bp, Homo sapiens
cacggcagccggaaggg

SEQ ID NO: 2415 - DNA, 17 bp, Homo sapiens
acggcagccggaagggg

SEQ ID NO: 2416 - DNA, 17 bp, Homo sapiens
cggcagccggaagggga

SEQ ID NO: 2417 - DNA, 17 bp, Homo sapiens
ggcagccggaaggggaa

SEQ ID NO: 2418 - DNA, 17 bp, Homo sapiens
gcagccggaaggggaaa

SEQ ID NO: 2419 - DNA, 17 bp, Homo sapiens
cagccggaaggggaaag

SEQ ID NO: 2420 - DNA, 17 bp, Homo sapiens
agccggaaggggaaagt

SEQ ID NO: 2421 - DNA, 17 bp, Homo sapiens
gccggaaggggaaagta

SEQ ID NO: 2422 - DNA, 17 bp, Homo sapiens
ccggaaggggaaagtaa

SEQ ID NO: 2423 - DNA, 17 bp, Homo sapiens
cggaaggggaaagtaac

SEQ ID NO: 2424 - DNA, 17 bp, Homo sapiens
ggaaggggaaagtaact

SEQ ID NO: 2425 - DNA, 17 bp, Homo sapiens
gaaggggaaagtaactt

SEQ ID NO: 2426 - DNA, 17 bp, Homo sapiens
aaggggaaagtaacttc

SEQ ID NO: 2427 - DNA, 17 bp, Homo sapiens
aggggaaagtaacttcc

SEQ ID NO: 2428 - DNA, 17 bp, Homo sapiens
ggggaaagtaacttcct

SEQ ID NO: 2429 - DNA, 17 bp, Homo sapiens
gggaaagtaacttcctg

SEQ ID NO: 2430 - DNA, 17 bp, Homo sapiens
ggaaagtaacttcctgg

SEQ ID NO: 2431 - DNA, 17 bp, Homo sapiens
gaaagtaacttcctggt

SEQ ID NO: 2432 - DNA, 17 bp, Homo sapiens
aaagtaacttcctggtt

SEQ ID NO: 2433 - DNA, 17 bp, Homo sapiens
aagtaacttcctggttt

SEQ ID NO: 2434 - DNA, 17 bp, Homo sapiens
agtaacttcctggtttt

SEQ ID NO: 2435 - DNA, 17 bp, Homo sapiens
gtaacttcctggttttc

SEQ ID NO: 2436 - DNA, 17 bp, Homo sapiens
taacttcctggttttct

SEQ ID NO: 2437 - DNA, 17 bp, Homo sapiens
aacttcctggttttctc

SEQ ID NO: 2438 - DNA, 17 bp, Homo sapiens
acttcctggttttctcc

SEQ ID NO: 2439 - DNA, 17 bp, Homo sapiens
cttcctggttttctccc

SEQ ID NO: 2440 - DNA, 17 bp, Homo sapiens
ttcctggttttctccca

SEQ ID NO: 2441 - DNA, 17 bp, Homo sapiens
tcctggttttctcccag

SEQ ID NO: 2442 - DNA, 17 bp, Homo sapiens
cctggttttctcccaga

SEQ ID NO: 2443 - DNA, 17 bp, Homo sapiens
ctggttttctcccagat

SEQ ID NO: 2444 - DNA, 17 bp, Homo sapiens
tggttttctcccagatg

SEQ ID NO: 2445 - DNA, 17 bp, Homo sapiens
ggttttctcccagatgc

SEQ ID NO: 2446 - DNA, 17 bp, Homo sapiens
gttttctcccagatgct

SEQ ID NO: 2447 - DNA, 17 bp, Homo sapiens
ttttctcccagatgctg

SEQ ID NO: 2448 - DNA, 17 bp, Homo sapiens
tttctcccagatgctgg

SEQ ID NO: 2449 - DNA, 17 bp, Homo sapiens
ttctcccagatgctggc

SEQ ID NO: 2450 - DNA, 17 bp, Homo sapiens
tctcccagatgctggct

SEQ ID NO: 2451 - DNA, 17 bp, Homo sapiens
ctcccagatgctggctg

SEQ ID NO: 2452 - DNA, 17 bp, Homo sapiens
tcccagatgctggctgg

SEQ ID NO: 2453 - DNA, 17 bp, Homo sapiens
cccagatgctggctgga

SEQ ID NO: 2454 - DNA, 17 bp, Homo sapiens
ccagatgctggctggat

SEQ ID NO: 2455 - DNA, 17 bp, Homo sapiens
cagatgctggctggatt

SEQ ID NO: 2456 - DNA, 17 bp, Homo sapiens
agatgctggctggattg

SEQ ID NO: 2457 - DNA, 17 bp, Homo sapiens
gatgctggctggattgg

SEQ ID NO: 2458 - DNA, 17 bp, Homo sapiens
atgctggctggattgga

SEQ ID NO: 2459 - DNA, 17 bp, Homo sapiens
tgctggctggattggac

SEQ ID NO: 2460 - DNA, 17 bp, Homo sapiens
gctggctggattggact

SEQ ID NO: 2461 - DNA, 17 bp, Homo sapiens
ctggctggattggactt

SEQ ID NO: 2462 - DNA, 17 bp, Homo sapiens
tggctggattggacttg

SEQ ID NO: 2463 - DNA, 17 bp, Homo sapiens
ggctggattggacttgg

SEQ ID NO: 2464 - DNA, 17 bp, Homo sapiens
gctggattggacttgga

SEQ ID NO: 2465 - DNA, 17 bp, Homo sapiens
ctggattggacttggat

SEQ ID NO: 2466 - DNA, 17 bp, Homo sapiens
tggattggacttggatc

SEQ ID NO: 2467 - DNA, 17 bp, Homo sapiens
ggattggacttggatct

SEQ ID NO: 2468 - DNA, 17 bp, Homo sapiens
gattggacttggatctc

SEQ ID NO: 2469 - DNA, 17 bp, Homo sapiens
attggacttggatctca

SEQ ID NO: 2470 - DNA, 17 bp, Homo sapiens
ttggacttggatctcag

SEQ ID NO: 2471 - DNA, 17 bp, Homo sapiens
tggacttggatctcagg

SEQ ID NO: 2472 - DNA, 17 bp, Homo sapiens
ggacttggatctcagga

SEQ ID NO: 2473 - DNA, 17 bp, Homo sapiens
gacttggatctcaggac

SEQ ID NO: 2474 - DNA, 17 bp, Homo sapiens
acttggatctcaggacg

SEQ ID NO: 2475 - DNA, 17 bp, Homo sapiens
cttggatctcaggacgg

SEQ ID NO: 2476 - DNA, 17 bp, Homo sapiens
ttggatctcaggacgga

SEQ ID NO: 2477 - DNA, 17 bp, Homo sapiens
tggatctcaggacggag

SEQ ID NO: 2478 - DNA, 17 bp, Homo sapiens
ggatctcaggacggagc

SEQ ID NO: 2479 - DNA, 17 bp, Homo sapiens
gatctcaggacggagct

SEQ ID NO: 2480 - DNA, 17 bp, Homo sapiens
atctcaggacggagctg

SEQ ID NO: 2481 - DNA, 17 bp, Homo sapiens
tctcaggacggagctga

SEQ ID NO: 2482 - DNA, 17 bp, Homo sapiens
ctcaggacggagctgaa

SEQ ID NO: 2483 - DNA, 17 bp, Homo sapiens
tcaggacggagctgaac

SEQ ID NO: 2484 - DNA, 17 bp, Homo sapiens
caggacggagctgaacc

SEQ ID NO: 2485 - DNA, 17 bp, Homo sapiens
aggacggagctgaacct

SEQ ID NO: 2486 - DNA, 17 bp, Homo sapiens
ggacggagctgaacctg

SEQ ID NO: 2487 - DNA, 17 bp, Homo sapiens
gacggagctgaacctgc

SEQ ID NO: 2488 - DNA, 17 bp, Homo sapiens
acggagctgaacctgca

SEQ ID NO: 2489 - DNA, 17 bp, Homo sapiens
cggagctgaacctgcac

SEQ ID NO: 2490 - DNA, 17 bp, Homo sapiens
ggagctgaacctgcacc

SEQ ID NO: 2491 - DNA, 17 bp, Homo sapiens
gagctgaacctgcacca

SEQ ID NO: 2492 - DNA, 17 bp, Homo sapiens
agctgaacctgcaccag

SEQ ID NO: 2493 - DNA, 17 bp, Homo sapiens
gctgaacctgcaccaga

SEQ ID NO: 2494 - DNA, 17 bp, Homo sapiens
ctgaacctgcaccagat

SEQ ID NO: 2495 - DNA, 17 bp, Homo sapiens
tgaacctgcaccagatg

SEQ ID NO: 2496 - DNA, 17 bp, Homo sapiens
gaacctgcaccagatgg

SEQ ID NO: 2497 - DNA, 17 bp, Homo sapiens
aacctgcaccagatggc

SEQ ID NO: 2498 - DNA, 17 bp, Homo sapiens
acctgcaccagatggca

SEQ ID NO: 2499 - DNA, 17 bp, Homo sapiens
cctgcaccagatggcag

SEQ ID NO: 2500 - DNA, 17 bp, Homo sapiens
ctgcaccagatggcaga

SEQ ID NO: 2501 - DNA, 17 bp, Homo sapiens
tgcaccagatggcagat

SEQ ID NO: 2502 - DNA, 17 bp, Homo sapiens
gcaccagatggcagata

SEQ ID NO: 2503 - DNA, 17 bp, Homo sapiens
caccagatggcagatag

SEQ ID NO: 2504 - DNA, 17 bp, Homo sapiens
accagatggcagatagc

SEQ ID NO: 2505 - DNA, 17 bp, Homo sapiens
ccagatggcagatagca

SEQ ID NO: 2506 - DNA, 17 bp, Homo sapiens
cagatggcagatagcag

SEQ ID NO: 2507 - DNA, 17 bp, Homo sapiens
agatggcagatagcagc

SEQ ID NO: 2508 - DNA, 17 bp, Homo sapiens
gatggcagatagcagct

SEQ ID NO: 2509 - DNA, 17 bp, Homo sapiens
atggcagatagcagctc

SEQ ID NO: 2510 - DNA, 17 bp, Homo sapiens
tggcagatagcagctcc

SEQ ID NO: 2511 - DNA, 17 bp, Homo sapiens
ggcagatagcagctcct

SEQ ID NO: 2512 - DNA, 17 bp, Homo sapiens
gcagatagcagctcctt

SEQ ID NO: 2513 - DNA, 17 bp, Homo sapiens
cagatagcagctccttt

SEQ ID NO: 2514 - DNA, 17 bp, Homo sapiens
agatagcagctcctttg

SEQ ID NO: 2515 - DNA, 17 bp, Homo sapiens
gatagcagctcctttgg

SEQ ID NO: 2516 - DNA, 17 bp, Homo sapiens
atagcagctcctttggc

SEQ ID NO: 2517 - DNA, 17 bp, Homo sapiens
tagcagctcctttggca

SEQ ID NO: 2518 - DNA, 17 bp, Homo sapiens
agcagctcctttggcat

SEQ ID NO: 2519 - DNA, 17 bp, Homo sapiens
gcagctcctttggcatg

SEQ ID NO: 2520 - DNA, 17 bp, Homo sapiens
cagctcctttggcatgg

SEQ ID NO: 2521 - DNA, 17 bp, Homo sapiens
agctcctttggcatggg

SEQ ID NO: 2522 - DNA, 17 bp, Homo sapiens
gctcctttggcatgggc

SEQ ID NO: 2523 - DNA, 17 bp, Homo sapiens
ctcctttggcatgggcg

SEQ ID NO: 2524 - DNA, 17 bp, Homo sapiens
tcctttggcatgggcgt

SEQ ID NO: 2525 - DNA, 17 bp, Homo sapiens
cctttggcatgggcgtg

SEQ ID NO: 2526 - DNA, 17 bp, Homo sapiens
ctttggcatgggcgtgt

SEQ ID NO: 2527 - DNA, 17 bp, Homo sapiens
tttggcatgggcgtgtg

SEQ ID NO: 2528 - DNA, 17 bp, Homo sapiens
ttggcatgggcgtgtgg

SEQ ID NO: 2529 - DNA, 17 bp, Homo sapiens
tggcatgggcgtgtggt

SEQ ID NO: 2530 - DNA, 17 bp, Homo sapiens
ggcatgggcgtgtggtc

SEQ ID NO: 2531 - DNA, 17 bp, Homo sapiens
gcatgggcgtgtggtcc

SEQ ID NO: 2532 - DNA, 17 bp, Homo sapiens
catgggcgtgtggtcca

SEQ ID NO: 2533 - DNA, 17 bp, Homo sapiens
atgggcgtgtggtccaa

SEQ ID NO: 2534 - DNA, 17 bp, Homo sapiens
tgggcgtgtggtccaag

SEQ ID NO: 2535 - DNA, 17 bp, Homo sapiens
gggcgtgtggtccaagc

SEQ ID NO: 2536 - DNA, 17 bp, Homo sapiens
ggcgtgtggtccaagcc

SEQ ID NO: 2537 - DNA, 17 bp, Homo sapiens
gcgtgtggtccaagcct

SEQ ID NO: 2538 - DNA, 17 bp, Homo sapiens
cgtgtggtccaagcctg

SEQ ID NO: 2539 - DNA, 17 bp, Homo sapiens
gtgtggtccaagcctga

SEQ ID NO: 2540 - DNA, 17 bp, Homo sapiens
tgtggtccaagcctgaa

SEQ ID NO: 2541 - DNA, 17 bp, Homo sapiens
gtggtccaagcctgaag

SEQ ID NO: 2542 - DNA, 17 bp, Homo sapiens
tggtccaagcctgaaga

SEQ ID NO: 2543 - DNA, 17 bp, Homo sapiens
ggtccaagcctgaagat

SEQ ID NO: 2544 - DNA, 17 bp, Homo sapiens
gtccaagcctgaagata

SEQ ID NO: 2545 - DNA, 17 bp, Homo sapiens
tccaagcctgaagataa

SEQ ID NO: 2546 - DNA, 17 bp, Homo sapiens
ccaagcctgaagataaa

SEQ ID NO: 2547 - DNA, 17 bp, Homo sapiens
caagcctgaagataaac

SEQ ID NO: 2548 - DNA, 17 bp, Homo sapiens
aagcctgaagataaaca

SEQ ID NO: 2549 - DNA, 17 bp, Homo sapiens
agcctgaagataaacag

SEQ ID NO: 2550 - DNA, 17 bp, Homo sapiens
gcctgaagataaacaga

SEQ ID NO: 2551 - DNA, 17 bp, Homo sapiens
cctgaagataaacagaa

SEQ ID NO: 2552 - DNA, 17 bp, Homo sapiens
ctgaagataaacagaag

SEQ ID NO: 2553 - DNA, 17 bp, Homo sapiens
tgaagataaacagaagg

SEQ ID NO: 2554 - DNA, 17 bp, Homo sapiens
gaagataaacagaaggc

SEQ ID NO: 2555 - DNA, 17 bp, Homo sapiens
aagataaacagaaggcg

SEQ ID NO: 2556 - DNA, 17 bp, Homo sapiens
agataaacagaaggcgg

SEQ ID NO: 2557 - DNA, 17 bp, Homo sapiens
gataaacagaaggcggc

SEQ ID NO: 2558 - DNA, 17 bp, Homo sapiens
ataaacagaaggcggca

SEQ ID NO: 2559 - DNA, 17 bp, Homo sapiens
taaacagaaggcggcag

SEQ ID NO: 2560 - DNA, 17 bp, Homo sapiens
aaacagaaggcggcagc

SEQ ID NO: 2561 - DNA, 17 bp, Homo sapiens
aacagaaggcggcagct

SEQ ID NO: 2562 - DNA, 17 bp, Homo sapiens
acagaaggcggcagctg

SEQ ID NO: 2563 - DNA, 17 bp, Homo sapiens
cagaaggcggcagctgc

SEQ ID NO: 2564 - DNA, 17 bp, Homo sapiens
agaaggcggcagctgcc

SEQ ID NO: 2565 - DNA, 17 bp, Homo sapiens
gaaggcggcagctgcct

SEQ ID NO: 2566 - DNA, 17 bp, Homo sapiens
aaggcggcagctgcctt

SEQ ID NO: 2567 - DNA, 17 bp, Homo sapiens
aggcggcagctgccttt

SEQ ID NO: 2568 - DNA, 17 bp, Homo sapiens
ggcggcagctgcctttg

SEQ ID NO: 2569 - DNA, 17 bp, Homo sapiens
gcggcagctgcctttgc

SEQ ID NO: 2570 - DNA, 17 bp, Homo sapiens
cggcagctgcctttgcc

SEQ ID NO: 2571 - DNA, 17 bp, Homo sapiens
ggcagctgcctttgccc

SEQ ID NO: 2572 - DNA, 17 bp, Homo sapiens
gcagctgcctttgccca

SEQ ID NO: 2573 - DNA, 17 bp, Homo sapiens
cagctgcctttgcccag

SEQ ID NO: 2574 - DNA, 17 bp, Homo sapiens
agctgcctttgcccagc

SEQ ID NO: 2575 - DNA, 17 bp, Homo sapiens
gctgcctttgcccagct

SEQ ID NO: 2576 - DNA, 17 bp, Homo sapiens
ctgcctttgcccagctc

SEQ ID NO: 2577 - DNA, 17 bp, Homo sapiens
tgcctttgcccagctcc

SEQ ID NO: 2578 - DNA, 17 bp, Homo sapiens
gcctttgcccagctcca

SEQ ID NO: 2579 - DNA, 17 bp, Homo sapiens
cctttgcccagctccag

SEQ ID NO: 2580 - DNA, 17 bp, Homo sapiens
ctttgcccagctccagg

SEQ ID NO: 2581 - DNA, 17 bp, Homo sapiens
tttgcccagctccaggg

SEQ ID NO: 2582 - DNA, 17 bp, Homo sapiens
ttgcccagctccagggt

SEQ ID NO: 2583 - DNA, 17 bp, Homo sapiens
tgcccagctccagggtg

SEQ ID NO: 2584 - DNA, 17 bp, Homo sapiens
gcccagctccagggtgc

SEQ ID NO: 2585 - DNA, 17 bp, Homo sapiens
cccagctccagggtgcc

SEQ ID NO: 2586 - DNA, 17 bp, Homo sapiens
ccagctccagggtgcca

SEQ ID NO: 2587 - DNA, 17 bp, Homo sapiens
cagctccagggtgccat

SEQ ID NO: 2588 - DNA, 17 bp, Homo sapiens
agctccagggtgccatg

SEQ ID NO: 2589 - DNA, 17 bp, Homo sapiens
gctccagggtgccatgg

SEQ ID NO: 2590 - DNA, 17 bp, Homo sapiens
ctccagggtgccatgga

SEQ ID NO: 2591 - DNA, 17 bp, Homo sapiens
tccagggtgccatggag

SEQ ID NO: 2592 - DNA, 17 bp, Homo sapiens
ccagggtgccatggaga

SEQ ID NO: 2593 - DNA, 17 bp, Homo sapiens
cagggtgccatggagat

SEQ ID NO: 2594 - DNA, 17 bp, Homo sapiens
agggtgccatggagatg

SEQ ID NO: 2595 - DNA, 17 bp, Homo sapiens
gggtgccatggagatgc

SEQ ID NO: 2596 - DNA, 17 bp, Homo sapiens
ggtgccatggagatgct

SEQ ID NO: 2597 - DNA, 17 bp, Homo sapiens
gtgccatggagatgctg

SEQ ID NO: 2598 - DNA, 17 bp, Homo sapiens
tgccatggagatgctgg

SEQ ID NO: 2599 - DNA, 17 bp, Homo sapiens
gccatggagatgctggg

SEQ ID NO: 2600 - DNA, 17 bp, Homo sapiens
ccatggagatgctgggc

SEQ ID NO: 2601 - DNA, 17 bp, Homo sapiens
catggagatgctgggca

SEQ ID NO: 2602 - DNA, 17 bp, Homo sapiens
atggagatgctgggcat

SEQ ID NO: 2603 - DNA, 17 bp, Homo sapiens
tggagatgctgggcatc

SEQ ID NO: 2604 - DNA, 17 bp, Homo sapiens
ggagatgctgggcatct

SEQ ID NO: 2605 - DNA, 17 bp, Homo sapiens
gagatgctgggcatctc

SEQ ID NO: 2606 - DNA, 17 bp, Homo sapiens
agatgctgggcatctca

SEQ ID NO: 2607 - DNA, 17 bp, Homo sapiens
gatgctgggcatctcag

SEQ ID NO: 2608 - DNA, 17 bp, Homo sapiens
atgctgggcatctcaga

SEQ ID NO: 2609 - DNA, 17 bp, Homo sapiens
tgctgggcatctcagag

SEQ ID NO: 2610 - DNA, 17 bp, Homo sapiens
gctgggcatctcagaga

SEQ ID NO: 2611 - DNA, 17 bp, Homo sapiens
ctgggcatctcagagag

SEQ ID NO: 2612 - DNA, 17 bp, Homo sapiens
tgggcatctcagagagc

SEQ ID NO: 2613 - DNA, 17 bp, Homo sapiens
gggcatctcagagagcg

SEQ ID NO: 2614 - DNA, 17 bp, Homo sapiens
ggcatctcagagagcga

SEQ ID NO: 2615 - DNA, 17 bp, Homo sapiens
gcatctcagagagcgag

SEQ ID NO: 2616 - DNA, 17 bp, Homo sapiens
catctcagagagcgagc

SEQ ID NO: 2617 - DNA, 17 bp, Homo sapiens
atctcagagagcgagca

SEQ ID NO: 2618 - DNA, 17 bp, Homo sapiens
tctcagagagcgagcag

SEQ ID NO: 2619 - DNA, 17 bp, Homo sapiens
ctcagagagcgagcagc

SEQ ID NO: 2620 - DNA, 17 bp, Homo sapiens
tcagagagcgagcagcg

SEQ ID NO: 2621 - DNA, 17 bp, Homo sapiens
cagagagcgagcagcgg

SEQ ID NO: 2622 - DNA, 17 bp, Homo sapiens
agagagcgagcagcggg

SEQ ID NO: 2623 - DNA, 17 bp, Homo sapiens
gagagcgagcagcgggc

SEQ ID NO: 2624 - DNA, 17 bp, Homo sapiens
agagcgagcagcgggct

SEQ ID NO: 2625 - DNA, 17 bp, Homo sapiens
gagcgagcagcgggctg

SEQ ID NO: 2626 - DNA, 17 bp, Homo sapiens
agcgagcagcgggctgt

SEQ ID NO: 2627 - DNA, 17 bp, Homo sapiens
gcgagcagcgggctgtt

SEQ ID NO: 2628 - DNA, 17 bp, Homo sapiens
cgagcagcgggctgttt

SEQ ID NO: 2629 - DNA, 17 bp, Homo sapiens
gagcagcgggctgtttg

SEQ ID NO: 2630 - DNA, 17 bp, Homo sapiens
agcagcgggctgtttgg

SEQ ID NO: 2631 - DNA, 17 bp, Homo sapiens
gcagcgggctgtttggc

SEQ ID NO: 2632 - DNA, 17 bp, Homo sapiens
cagcgggctgtttggcg

SEQ ID NO: 2633 - DNA, 17 bp, Homo sapiens
agcgggctgtttggcgg

SEQ ID NO: 2634 - DNA, 17 bp, Homo sapiens
gcgggctgtttggcggg

SEQ ID NO: 2635 - DNA, 17 bp, Homo sapiens
cgggctgtttggcgggt

SEQ ID NO: 2636 - DNA, 17 bp, Homo sapiens
gggctgtttggcgggtc

SEQ ID NO: 2637 - DNA, 17 bp, Homo sapiens
ggctgtttggcgggtcc

SEQ ID NO: 2638 - DNA, 17 bp, Homo sapiens
gctgtttggcgggtcct

SEQ ID NO: 2639 - DNA, 17 bp, Homo sapiens
ctgtttggcgggtcctg

SEQ ID NO: 2640 - DNA, 17 bp, Homo sapiens
tgtttggcgggtcctgg

SEQ ID NO: 2641 - DNA, 17 bp, Homo sapiens
gtttggcgggtcctggc

SEQ ID NO: 2642 - DNA, 17 bp, Homo sapiens
tttggcgggtcctggca

SEQ ID NO: 2643 - DNA, 17 bp, Homo sapiens
ttggcgggtcctggcag

SEQ ID NO: 2644 - DNA, 17 bp, Homo sapiens
tggcgggtcctggcagc

SEQ ID NO: 2645 - DNA, 17 bp, Homo sapiens
ggcgggtcctggcagcc

SEQ ID NO: 2646 - DNA, 17 bp, Homo sapiens
gcgggtcctggcagcca

SEQ ID NO: 2647 - DNA, 17 bp, Homo sapiens
cgggtcctggcagccat

SEQ ID NO: 2648 - DNA, 17 bp, Homo sapiens
gggtcctggcagccatc

SEQ ID NO: 2649 - DNA, 17 bp, Homo sapiens
ggtcctggcagccatct

SEQ ID NO: 2650 - DNA, 17 bp, Homo sapiens
gtcctggcagccatcta

SEQ ID NO: 2651 - DNA, 17 bp, Homo sapiens
tcctggcagccatctac

SEQ ID NO: 2652 - DNA, 17 bp, Homo sapiens
cctggcagccatctacc

SEQ ID NO: 2653 - DNA, 17 bp, Homo sapiens
ctggcagccatctacca

SEQ ID NO: 2654 - DNA, 17 bp, Homo sapiens
tggcagccatctaccac

SEQ ID NO: 2655 - DNA, 17 bp, Homo sapiens
ggcagccatctaccacc

SEQ ID NO: 2656 - DNA, 17 bp, Homo sapiens
gcagccatctaccacct

SEQ ID NO: 2657 - DNA, 17 bp, Homo sapiens
cagccatctaccacctg

SEQ ID NO: 2658 - DNA, 17 bp, Homo sapiens
agccatctaccacctgg

SEQ ID NO: 2659 - DNA, 17 bp, Homo sapiens
gccatctaccacctggg

SEQ ID NO: 2660 - DNA, 17 bp, Homo sapiens
ccatctaccacctgggc

SEQ ID NO: 2661 - DNA, 17 bp, Homo sapiens
catctaccacctgggcg

SEQ ID NO: 2662 - DNA, 17 bp, Homo sapiens
atctaccacctgggcgc

SEQ ID NO: 2663 - DNA, 17 bp, Homo sapiens
tctaccacctgggcgcg

SEQ ID NO: 2664 - DNA, 17 bp, Homo sapiens
ctaccacctgggcgcgg

SEQ ID NO: 2665 - DNA, 17 bp, Homo sapiens
taccacctgggcgcggc

SEQ ID NO: 2666 - DNA, 17 bp, Homo sapiens
accacctgggcgcggcg

SEQ ID NO: 2667 - DNA, 17 bp, Homo sapiens
ccacctgggcgcggcgg

SEQ ID NO: 2668 - DNA, 17 bp, Homo sapiens
cacctgggcgcggcggg

SEQ ID NO: 2669 - DNA, 17 bp, Homo sapiens
acctgggcgcggcgggg

SEQ ID NO: 2670 - DNA, 17 bp, Homo sapiens
cctgggcgcggcggggg

SEQ ID NO: 2671 - DNA, 17 bp, Homo sapiens
ctgggcgcggcgggggc

SEQ ID NO: 2672 - DNA, 17 bp, Homo sapiens
tgggcgcggcgggggcc

SEQ ID NO: 2673 - DNA, 17 bp, Homo sapiens
gggcgcggcgggggcct

SEQ ID NO: 2674 - DNA, 17 bp, Homo sapiens
ggcgcggcgggggcctg

SEQ ID NO: 2675 - DNA, 17 bp, Homo sapiens
gcgcggcgggggcctgc

SEQ ID NO: 2676 - DNA, 17 bp, Homo sapiens
cgcggcgggggcctgca

SEQ ID NO: 2677 - DNA, 17 bp, Homo sapiens
gcggcgggggcctgcaa

SEQ ID NO: 2678 - DNA, 17 bp, Homo sapiens
cggcgggggcctgcaaa

SEQ ID NO: 2679 - DNA, 17 bp, Homo sapiens
ggcgggggcctgcaaag

SEQ ID NO: 2680 - DNA, 17 bp, Homo sapiens
gcgggggcctgcaaagt

SEQ ID NO: 2681 - DNA, 17 bp, Homo sapiens
cgggggcctgcaaagtg

SEQ ID NO: 2682 - DNA, 17 bp, Homo sapiens
gggggcctgcaaagtgg

SEQ ID NO: 2683 - DNA, 17 bp, Homo sapiens
ggggcctgcaaagtggg

SEQ ID NO: 2684 - DNA, 17 bp, Homo sapiens
gggcctgcaaagtgggt

SEQ ID NO: 2685 - DNA, 17 bp, Homo sapiens
ggcctgcaaagtgggtc

SEQ ID NO: 2686 - DNA, 17 bp, Homo sapiens
gcctgcaaagtgggtcg

SEQ ID NO: 2687 - DNA, 17 bp, Homo sapiens
cctgcaaagtgggtcgg

SEQ ID NO: 2688 - DNA, 17 bp, Homo sapiens
ctgcaaagtgggtcgga

SEQ ID NO: 2689 - DNA, 17 bp, Homo sapiens
tgcaaagtgggtcggaa

SEQ ID NO: 2690 - DNA, 17 bp, Homo sapiens
gcaaagtgggtcggaag

SEQ ID NO: 2691 - DNA, 17 bp, Homo sapiens
caaagtgggtcggaagc

SEQ ID NO: 2692 - DNA, 17 bp, Homo sapiens
aaagtgggtcggaagca

SEQ ID NO: 2693 - DNA, 17 bp, Homo sapiens
aagtgggtcggaagcag

SEQ ID NO: 2694 - DNA, 17 bp, Homo sapiens
agtgggtcggaagcagt

SEQ ID NO: 2695 - DNA, 17 bp, Homo sapiens
gtgggtcggaagcagtt

SEQ ID NO: 2696 - DNA, 17 bp, Homo sapiens
tgggtcggaagcagttc

SEQ ID NO: 2697 - DNA, 17 bp, Homo sapiens
gggtcggaagcagttca

SEQ ID NO: 2698 - DNA, 17 bp, Homo sapiens
ggtcggaagcagttcat

SEQ ID NO: 2699 - DNA, 17 bp, Homo sapiens
gtcggaagcagttcatg

SEQ ID NO: 2700 - DNA, 17 bp, Homo sapiens
tcggaagcagttcatga

SEQ ID NO: 2701 - DNA, 17 bp, Homo sapiens
cggaagcagttcatgag

SEQ ID NO: 2702 - DNA, 17 bp, Homo sapiens
ggaagcagttcatgagg

SEQ ID NO: 2703 - DNA, 17 bp, Homo sapiens
gaagcagttcatgaggt

SEQ ID NO: 2704 - DNA, 17 bp, Homo sapiens
aagcagttcatgaggtt

SEQ ID NO: 2705 - DNA, 17 bp, Homo sapiens
agcagttcatgaggttt

SEQ ID NO: 2706 - DNA, 17 bp, Homo sapiens
gcagttcatgaggtttg

SEQ ID NO: 2707 - DNA, 17 bp, Homo sapiens
cagttcatgaggtttga

SEQ ID NO: 2708 - DNA, 17 bp, Homo sapiens
agttcatgaggtttgag

SEQ ID NO: 2709 - DNA, 17 bp, Homo sapiens
gttcatgaggtttgagt

SEQ ID NO: 2710 - DNA, 17 bp, Homo sapiens
ttcatgaggtttgagtg

SEQ ID NO: 2711 - DNA, 17 bp, Homo sapiens
tcatgaggtttgagtgg

SEQ ID NO: 2712 - DNA, 17 bp, Homo sapiens
catgaggtttgagtggg

SEQ ID NO: 2713 - DNA, 17 bp, Homo sapiens
atgaggtttgagtgggc

SEQ ID NO: 2714 - DNA, 17 bp, Homo sapiens
tgaggtttgagtgggca

SEQ ID NO: 2715 - DNA, 17 bp, Homo sapiens
gaggtttgagtgggcaa

SEQ ID NO: 2716 - DNA, 17 bp, Homo sapiens
aggtttgagtgggcaaa

SEQ ID NO: 2717 - DNA, 17 bp, Homo sapiens
ggtttgagtgggcaaac

SEQ ID NO: 2718 - DNA, 17 bp, Homo sapiens
gtttgagtgggcaaact

SEQ ID NO: 2719 - DNA, 17 bp, Homo sapiens
tttgagtgggcaaacta

SEQ ID NO: 2720 - DNA, 17 bp, Homo sapiens
ttgagtgggcaaactac

SEQ ID NO: 2721 - DNA, 17 bp, Homo sapiens
tgagtgggcaaactacg

SEQ ID NO: 2722 - DNA, 17 bp, Homo sapiens
gagtgggcaaactacgc

SEQ ID NO: 2723 - DNA, 17 bp, Homo sapiens
agtgggcaaactacgca

SEQ ID NO: 2724 - DNA, 17 bp, Homo sapiens
gtgggcaaactacgcag

SEQ ID NO: 2725 - DNA, 17 bp, Homo sapiens
tgggcaaactacgcagc

SEQ ID NO: 2726 - DNA, 17 bp, Homo sapiens
gggcaaactacgcagct

SEQ ID NO: 2727 - DNA, 17 bp, Homo sapiens
ggcaaactacgcagctg

SEQ ID NO: 2728 - DNA, 17 bp, Homo sapiens
gcaaactacgcagctga

SEQ ID NO: 2729 - DNA, 17 bp, Homo sapiens
caaactacgcagctgag

SEQ ID NO: 2730 - DNA, 17 bp, Homo sapiens
aaactacgcagctgagg

SEQ ID NO: 2731 - DNA, 17 bp, Homo sapiens
aactacgcagctgaggc

SEQ ID NO: 2732 - DNA, 17 bp, Homo sapiens
actacgcagctgaggcc

SEQ ID NO: 2733 - DNA, 17 bp, Homo sapiens
ctacgcagctgaggccc

SEQ ID NO: 2734 - DNA, 17 bp, Homo sapiens
tacgcagctgaggccct

SEQ ID NO: 2735 - DNA, 17 bp, Homo sapiens
acgcagctgaggccctg

SEQ ID NO: 2736 - DNA, 17 bp, Homo sapiens
cgcagctgaggccctgg

SEQ ID NO: 2737 - DNA, 17 bp, Homo sapiens
gcagctgaggccctggg

SEQ ID NO: 2738 - DNA, 17 bp, Homo sapiens
cagctgaggccctgggc

SEQ ID NO: 2739 - DNA, 17 bp, Homo sapiens
agctgaggccctgggct

SEQ ID NO: 2740 - DNA, 17 bp, Homo sapiens
gctgaggccctgggctg

SEQ ID NO: 2741 - DNA, 17 bp, Homo sapiens
ctgaggccctgggctgc

SEQ ID NO: 2742 - DNA, 17 bp, Homo sapiens
tgaggccctgggctgcg

SEQ ID NO: 2743 - DNA, 17 bp, Homo sapiens
gaggccctgggctgcga

SEQ ID NO: 2744 - DNA, 17 bp, Homo sapiens
aggccctgggctgcgag

SEQ ID NO: 2745 - DNA, 17 bp, Homo sapiens
ggccctgggctgcgagt

SEQ ID NO: 2746 - DNA, 17 bp, Homo sapiens
gccctgggctgcgagta

SEQ ID NO: 2747 - DNA, 17 bp, Homo sapiens
ccctgggctgcgagtat

SEQ ID NO: 2748 - DNA, 17 bp, Homo sapiens
cctgggctgcgagtatg

SEQ ID NO: 2749 - DNA, 17 bp, Homo sapiens
ctgggctgcgagtatga

SEQ ID NO: 2750 - DNA, 17 bp, Homo sapiens
tgggctgcgagtatgag

SEQ ID NO: 2751 - DNA, 17 bp, Homo sapiens
gggctgcgagtatgagg

SEQ ID NO: 2752 - DNA, 17 bp, Homo sapiens
ggctgcgagtatgagga

SEQ ID NO: 2753 - DNA, 17 bp, Homo sapiens
gctgcgagtatgaggag

SEQ ID NO: 2754 - DNA, 17 bp, Homo sapiens
ctgcgagtatgaggagc

SEQ ID NO: 2755 - DNA, 17 bp, Homo sapiens
tgcgagtatgaggagct

SEQ ID NO: 2756 - DNA, 17 bp, Homo sapiens
gcgagtatgaggagctg

SEQ ID NO: 2757 - DNA, 17 bp, Homo sapiens
cgagtatgaggagctga

SEQ ID NO: 2758 - DNA, 17 bp, Homo sapiens
gagtatgaggagctgaa

SEQ ID NO: 2759 - DNA, 17 bp, Homo sapiens
agtatgaggagctgaac

SEQ ID NO: 2760 - DNA, 17 bp, Homo sapiens
gtatgaggagctgaaca

SEQ ID NO: 2761 - DNA, 17 bp, Homo sapiens
tatgaggagctgaacac

SEQ ID NO: 2762 - DNA, 17 bp, Homo sapiens
atgaggagctgaacacg

SEQ ID NO: 2763 - DNA, 17 bp, Homo sapiens
tgaggagctgaacacgg

SEQ ID NO: 2764 - DNA, 17 bp, Homo sapiens
gaggagctgaacacggc

SEQ ID NO: 2765 - DNA, 17 bp, Homo sapiens
aggagctgaacacggcc

SEQ ID NO: 2766 - DNA, 17 bp, Homo sapiens
ggagctgaacacggcca

SEQ ID NO: 2767 - DNA, 17 bp, Homo sapiens
gagctgaacacggccac

SEQ ID NO: 2768 - DNA, 17 bp, Homo sapiens
agctgaacacggccacc

SEQ ID NO: 2769 - DNA, 17 bp, Homo sapiens
gctgaacacggccacct

SEQ ID NO: 2770 - DNA, 17 bp, Homo sapiens
ctgaacacggccacctt

SEQ ID NO: 2771 - DNA, 17 bp, Homo sapiens
tgaacacggccaccttc

SEQ ID NO: 2772 - DNA, 17 bp, Homo sapiens
gaacacggccaccttca

SEQ ID NO: 2773 - DNA, 17 bp, Homo sapiens
aacacggccaccttcaa

SEQ ID NO: 2774 - DNA, 17 bp, Homo sapiens
acacggccaccttcaag

SEQ ID NO: 2775 - DNA, 17 bp, Homo sapiens
cacggccaccttcaagc

SEQ ID NO: 2776 - DNA, 17 bp, Homo sapiens
acggccaccttcaagca

SEQ ID NO: 2777 - DNA, 17 bp, Homo sapiens
cggccaccttcaagcac

SEQ ID NO: 2778 - DNA, 17 bp, Homo sapiens
ggccaccttcaagcacc

SEQ ID NO: 2779 - DNA, 17 bp, Homo sapiens
gccaccttcaagcacca

SEQ ID NO: 2780 - DNA, 17 bp, Homo sapiens
ccaccttcaagcaccac

SEQ ID NO: 2781 - DNA, 17 bp, Homo sapiens
caccttcaagcaccacc

SEQ ID NO: 2782 - DNA, 17 bp, Homo sapiens
accttcaagcaccacct

SEQ ID NO: 2783 - DNA, 17 bp, Homo sapiens
ccttcaagcaccacctt

SEQ ID NO: 2784 - DNA, 17 bp, Homo sapiens
cttcaagcaccaccttc

SEQ ID NO: 2785 - DNA, 17 bp, Homo sapiens
ttcaagcaccaccttcg

SEQ ID NO: 2786 - DNA, 17 bp, Homo sapiens
tcaagcaccaccttcga

SEQ ID NO: 2787 - DNA, 17 bp, Homo sapiens
caagcaccaccttcgac

SEQ ID NO: 2788 - DNA, 17 bp, Homo sapiens
aagcaccaccttcgaca

SEQ ID NO: 2789 - DNA, 17 bp, Homo sapiens
agcaccaccttcgacag

SEQ ID NO: 2790 - DNA, 17 bp, Homo sapiens
gcaccaccttcgacaga

SEQ ID NO: 2791 - DNA, 17 bp, Homo sapiens
caccaccttcgacagat

SEQ ID NO: 2792 - DNA, 17 bp, Homo sapiens
accaccttcgacagatc

SEQ ID NO: 2793 - DNA, 17 bp, Homo sapiens
ccaccttcgacagatca

SEQ ID NO: 2794 - DNA, 17 bp, Homo sapiens
caccttcgacagatcat

SEQ ID NO: 2795 - DNA, 17 bp, Homo sapiens
accttcgacagatcatc

SEQ ID NO: 2796 - DNA, 17 bp, Homo sapiens
ccttcgacagatcatcc

SEQ ID NO: 2797 - DNA, 17 bp, Homo sapiens
cttcgacagatcatcca

SEQ ID NO: 2798 - DNA, 17 bp, Homo sapiens
ttcgacagatcatccag

SEQ ID NO: 2799 - DNA, 17 bp, Homo sapiens
tcgacagatcatccagc

SEQ ID NO: 2800 - DNA, 17 bp, Homo sapiens
cgacagatcatccagca

SEQ ID NO: 2801 - DNA, 17 bp, Homo sapiens
gacagatcatccagcaa

SEQ ID NO: 2802 - DNA, 17 bp, Homo sapiens
acagatcatccagcaaa

SEQ ID NO: 2803 - DNA, 17 bp, Homo sapiens
cagatcatccagcaaat

SEQ ID NO: 2804 - DNA, 17 bp, Homo sapiens
agatcatccagcaaatg

SEQ ID NO: 2805 - DNA, 17 bp, Homo sapiens
gatcatccagcaaatga

SEQ ID NO: 2806 - DNA, 17 bp, Homo sapiens
atcatccagcaaatgac

SEQ ID NO: 2807 - DNA, 17 bp, Homo sapiens
tcatccagcaaatgacg

SEQ ID NO: 2808 - DNA, 17 bp, Homo sapiens
catccagcaaatgacgt

SEQ ID NO: 2809 - DNA, 17 bp, Homo sapiens
atccagcaaatgacgtt

SEQ ID NO: 2810 - DNA, 17 bp, Homo sapiens
tccagcaaatgacgttt

SEQ ID NO: 2811 - DNA, 17 bp, Homo sapiens
ccagcaaatgacgtttg

SEQ ID NO: 2812 - DNA, 17 bp, Homo sapiens
cagcaaatgacgtttgg

SEQ ID NO: 2813 - DNA, 17 bp, Homo sapiens
agcaaatgacgtttggg

SEQ ID NO: 2814 - DNA, 17 bp, Homo sapiens
gcaaatgacgtttgggc

SEQ ID NO: 2815 - DNA, 17 bp, Homo sapiens
caaatgacgtttgggcc

SEQ ID NO: 2816 - DNA, 17 bp, Homo sapiens
aaatgacgtttgggcca

SEQ ID NO: 2817 - DNA, 17 bp, Homo sapiens
aatgacgtttgggccaa

SEQ ID NO: 2818 - DNA, 17 bp, Homo sapiens
atgacgtttgggccaag

SEQ ID NO: 2819 - DNA, 17 bp, Homo sapiens
tgacgtttgggccaagc

SEQ ID NO: 2820 - DNA, 17 bp, Homo sapiens
gacgtttgggccaagcc

SEQ ID NO: 2821 - DNA, 17 bp, Homo sapiens
acgtttgggccaagccg

SEQ ID NO: 2822 - DNA, 17 bp, Homo sapiens
cgtttgggccaagccga

SEQ ID NO: 2823 - DNA, 17 bp, Homo sapiens
gtttgggccaagccgat

SEQ ID NO: 2824 - DNA, 17 bp, Homo sapiens
tttgggccaagccgatg

SEQ ID NO: 2825 - DNA, 17 bp, Homo sapiens
ttgggccaagccgatgg

SEQ ID NO: 2826 - DNA, 17 bp, Homo sapiens
tgggccaagccgatggg

SEQ ID NO: 2827 - DNA, 17 bp, Homo sapiens
gggccaagccgatgggg

SEQ ID NO: 2828 - DNA, 17 bp, Homo sapiens
ggccaagccgatggggc

SEQ ID NO: 2829 - DNA, 17 bp, Homo sapiens
gccaagccgatggggcc

SEQ ID NO: 2830 - DNA, 17 bp, Homo sapiens
ccaagccgatggggcct

SEQ ID NO: 2831 - DNA, 17 bp, Homo sapiens
caagccgatggggcctc

SEQ ID NO: 2832 - DNA, 17 bp, Homo sapiens
aagccgatggggcctcg

SEQ ID NO: 2833 - DNA, 17 bp, Homo sapiens
agccgatggggcctcga

SEQ ID NO: 2834 - DNA, 17 bp, Homo sapiens
gccgatggggcctcgag

SEQ ID NO: 2835 - DNA, 17 bp, Homo sapiens
ccgatggggcctcgagg

SEQ ID NO: 2836 - DNA, 17 bp, Homo sapiens
cgatggggcctcgagga

SEQ ID NO: 2837 - DNA, 17 bp, Homo sapiens
gatggggcctcgaggat

SEQ ID NO: 2838 - DNA, 17 bp, Homo sapiens
atggggcctcgaggatg

SEQ ID NO: 2839 - DNA, 17 bp, Homo sapiens
tggggcctcgaggatga

SEQ ID NO: 2840 - DNA, 17 bp, Homo sapiens
ggggcctcgaggatgag

SEQ ID NO: 2841 - DNA, 17 bp, Homo sapiens
gggcctcgaggatgagg

SEQ ID NO: 2842 - DNA, 17 bp, Homo sapiens
ggcctcgaggatgagga

SEQ ID NO: 2843 - DNA, 17 bp, Homo sapiens
gcctcgaggatgaggaa

SEQ ID NO: 2844 - DNA, 17 bp, Homo sapiens
cctcgaggatgaggaaa

SEQ ID NO: 2845 - DNA, 17 bp, Homo sapiens
ctcgaggatgaggaaac

SEQ ID NO: 2846 - DNA, 17 bp, Homo sapiens
tcgaggatgaggaaacc

SEQ ID NO: 2847 - DNA, 17 bp, Homo sapiens
cgaggatgaggaaacca

SEQ ID NO: 2848 - DNA, 17 bp, Homo sapiens
gaggatgaggaaaccag

SEQ ID NO: 2849 - DNA, 17 bp, Homo sapiens
aggatgaggaaaccagc

SEQ ID NO: 2850 - DNA, 17 bp, Homo sapiens
ggatgaggaaaccagct

SEQ ID NO: 2851 - DNA, 17 bp, Homo sapiens
gatgaggaaaccagctc

SEQ ID NO: 2852 - DNA, 17 bp, Homo sapiens
atgaggaaaccagctca

SEQ ID NO: 2853 - DNA, 17 bp, Homo sapiens
tgaggaaaccagctcag

SEQ ID NO: 2854 - DNA, 17 bp, Homo sapiens
gaggaaaccagctcagg

SEQ ID NO: 2855 - DNA, 17 bp, Homo sapiens
aggaaaccagctcaggg

SEQ ID NO: 2856 - DNA, 17 bp, Homo sapiens
ggaaaccagctcagggc

SEQ ID NO: 2857 - DNA, 17 bp, Homo sapiens
gaaaccagctcagggct

SEQ ID NO: 2858 - DNA, 17 bp, Homo sapiens
aaaccagctcagggctc

SEQ ID NO: 2859 - DNA, 17 bp, Homo sapiens
aaccagctcagggctca

SEQ ID NO: 2860 - DNA, 17 bp, Homo sapiens
accagctcagggctcaa

SEQ ID NO: 2861 - DNA, 17 bp, Homo sapiens
ccagctcagggctcaag

SEQ ID NO: 2862 - DNA, 17 bp, Homo sapiens
cagctcagggctcaaga

SEQ ID NO: 2863 - DNA, 17 bp, Homo sapiens
agctcagggctcaagat

SEQ ID NO: 2864 - DNA, 17 bp, Homo sapiens
gctcagggctcaagatg

SEQ ID NO: 2865 - DNA, 17 bp, Homo sapiens
ctcagggctcaagatga

SEQ ID NO: 2866 - DNA, 17 bp, Homo sapiens
tcagggctcaagatgac

SEQ ID NO: 2867 - DNA, 17 bp, Homo sapiens
cagggctcaagatgaca

SEQ ID NO: 2868 - DNA, 17 bp, Homo sapiens
agggctcaagatgacag

SEQ ID NO: 2869 - DNA, 17 bp, Homo sapiens
gggctcaagatgacagg

SEQ ID NO: 2870 - DNA, 17 bp, Homo sapiens
ggctcaagatgacagga

SEQ ID NO: 2871 - DNA, 17 bp, Homo sapiens
gctcaagatgacaggag

SEQ ID NO: 2872 - DNA, 17 bp, Homo sapiens
ctcaagatgacaggagt

SEQ ID NO: 2873 - DNA, 17 bp, Homo sapiens
tcaagatgacaggagtg

SEQ ID NO: 2874 - DNA, 17 bp, Homo sapiens
caagatgacaggagtgg

SEQ ID NO: 2875 - DNA, 17 bp, Homo sapiens
aagatgacaggagtgga

SEQ ID NO: 2876 - DNA, 17 bp, Homo sapiens
agatgacaggagtggac

SEQ ID NO: 2877 - DNA, 17 bp, Homo sapiens
gatgacaggagtggact

SEQ ID NO: 2878 - DNA, 17 bp, Homo sapiens
atgacaggagtggactg

SEQ ID NO: 2879 - DNA, 17 bp, Homo sapiens
tgacaggagtggactgt

SEQ ID NO: 2880 - DNA, 17 bp, Homo sapiens
gacaggagtggactgtg

SEQ ID NO: 2881 - DNA, 17 bp, Homo sapiens
acaggagtggactgtgt

SEQ ID NO: 2882 - DNA, 17 bp, Homo sapiens
caggagtggactgtgtg

SEQ ID NO: 2883 - DNA, 17 bp, Homo sapiens
aggagtggactgtgtgg

SEQ ID NO: 2884 - DNA, 17 bp, Homo sapiens
ggagtggactgtgtgga

SEQ ID NO: 2885 - DNA, 17 bp, Homo sapiens
gagtggactgtgtggag

SEQ ID NO: 2886 - DNA, 17 bp, Homo sapiens
agtggactgtgtggagg

SEQ ID NO: 2887 - DNA, 17 bp, Homo sapiens
gtggactgtgtggaggg

SEQ ID NO: 2888 - DNA, 17 bp, Homo sapiens
tggactgtgtggagggg

SEQ ID NO: 2889 - DNA, 17 bp, Homo sapiens
ggactgtgtggagggga

SEQ ID NO: 2890 - DNA, 17 bp, Homo sapiens
gactgtgtggaggggat

SEQ ID NO: 2891 - DNA, 17 bp, Homo sapiens
actgtgtggaggggatg

SEQ ID NO: 2892 - DNA, 17 bp, Homo sapiens
ctgtgtggaggggatgg

SEQ ID NO: 2893 - DNA, 17 bp, Homo sapiens
tgtgtggaggggatggc

SEQ ID NO: 2894 - DNA, 17 bp, Homo sapiens
gtgtggaggggatggcc

SEQ ID NO: 2895 - DNA, 17 bp, Homo sapiens
tgtggaggggatggcct

SEQ ID NO: 2896 - DNA, 17 bp, Homo sapiens
gtggaggggatggcctc

SEQ ID NO: 2897 - DNA, 17 bp, Homo sapiens
tggaggggatggcctcg

SEQ ID NO: 2898 - DNA, 17 bp, Homo sapiens
ggaggggatggcctcgg

SEQ ID NO: 2899 - DNA, 17 bp, Homo sapiens
gaggggatggcctcggg

SEQ ID NO: 2900 - DNA, 17 bp, Homo sapiens
aggggatggcctcgggc

SEQ ID NO: 2901 - DNA, 17 bp, Homo sapiens
ggggatggcctcgggcc

SEQ ID NO: 2902 - DNA, 17 bp, Homo sapiens
gggatggcctcgggcct

SEQ ID NO: 2903 - DNA, 17 bp, Homo sapiens
ggatggcctcgggcctg

SEQ ID NO: 2904 - DNA, 17 bp, Homo sapiens
gatggcctcgggcctgt

SEQ ID NO: 2905 - DNA, 17 bp, Homo sapiens
atggcctcgggcctgta

SEQ ID NO: 2906 - DNA, 17 bp, Homo sapiens
tggcctcgggcctgtac

SEQ ID NO: 2907 - DNA, 17 bp, Homo sapiens
ggcctcgggcctgtacc

SEQ ID NO: 2908 - DNA, 17 bp, Homo sapiens
gcctcgggcctgtacca

SEQ ID NO: 2909 - DNA, 17 bp, Homo sapiens
cctcgggcctgtaccag

SEQ ID NO: 2910 - DNA, 17 bp, Homo sapiens
ctcgggcctgtaccagg

SEQ ID NO: 2911 - DNA, 17 bp, Homo sapiens
tcgggcctgtaccagga

SEQ ID NO: 2912 - DNA, 17 bp, Homo sapiens
cgggcctgtaccaggaa

SEQ ID NO: 2913 - DNA, 17 bp, Homo sapiens
gggcctgtaccaggaac

SEQ ID NO: 2914 - DNA, 17 bp, Homo sapiens
ggcctgtaccaggaact

SEQ ID NO: 2915 - DNA, 17 bp, Homo sapiens
gcctgtaccaggaactc

SEQ ID NO: 2916 - DNA, 17 bp, Homo sapiens
cctgtaccaggaactct

SEQ ID NO: 2917 - DNA, 17 bp, Homo sapiens
ctgtaccaggaactctt

SEQ ID NO: 2918 - DNA, 17 bp, Homo sapiens
tgtaccaggaactcttt

SEQ ID NO: 2919 - DNA, 17 bp, Homo sapiens
gtaccaggaactctttg

SEQ ID NO: 2920 - DNA, 17 bp, Homo sapiens
taccaggaactctttgc

SEQ ID NO: 2921 - DNA, 17 bp, Homo sapiens
accaggaactctttgcg

SEQ ID NO: 2922 - DNA, 17 bp, Homo sapiens
ccaggaactctttgcgg

SEQ ID NO: 2923 - DNA, 17 bp, Homo sapiens
caggaactctttgcggc

SEQ ID NO: 2924 - DNA, 17 bp, Homo sapiens
aggaactctttgcggct

SEQ ID NO: 2925 - DNA, 17 bp, Homo sapiens
ggaactctttgcggctg

SEQ ID NO: 2926 - DNA, 17 bp, Homo sapiens
gaactctttgcggctgt

SEQ ID NO: 2927 - DNA, 17 bp, Homo sapiens
aactctttgcggctgtg

SEQ ID NO: 2928 - DNA, 17 bp, Homo sapiens
actctttgcggctgtgg

SEQ ID NO: 2929 - DNA, 17 bp, Homo sapiens
ctctttgcggctgtggt

SEQ ID NO: 2930 - DNA, 17 bp, Homo sapiens
tctttgcggctgtggtc

SEQ ID NO: 2931 - DNA, 17 bp, Homo sapiens
ctttgcggctgtggtct

SEQ ID NO: 2932 - DNA, 17 bp, Homo sapiens
tttgcggctgtggtctc

SEQ ID NO: 2933 - DNA, 17 bp, Homo sapiens
ttgcggctgtggtctca

SEQ ID NO: 2934 - DNA, 17 bp, Homo sapiens
tgcggctgtggtctcac

SEQ ID NO: 2935 - DNA, 17 bp, Homo sapiens
gcggctgtggtctcact

SEQ ID NO: 2936 - DNA, 17 bp, Homo sapiens
cggctgtggtctcactc

SEQ ID NO: 2937 - DNA, 17 bp, Homo sapiens
ggctgtggtctcactca

SEQ ID NO: 2938 - DNA, 17 bp, Homo sapiens
gctgtggtctcactcat

SEQ ID NO: 2939 - DNA, 17 bp, Homo sapiens
ctgtggtctcactcatc

SEQ ID NO: 2940 - DNA, 17 bp, Homo sapiens
tgtggtctcactcatca

SEQ ID NO: 2941 - DNA, 17 bp, Homo sapiens
gtggtctcactcatcaa

SEQ ID NO: 2942 - DNA, 17 bp, Homo sapiens
tggtctcactcatcaac

SEQ ID NO: 2943 - DNA, 25 bp, Homo sapiens
cacccggggagacgtcttagacagt

SEQ ID NO: 2944 - DNA, 25 bp, Homo sapiens
acccggggagacgtcttagacagtc

SEQ ID NO: 2945 - DNA, 25 bp, Homo sapiens
cccggggagacgtcttagacagtcg

SEQ ID NO: 2946 - DNA, 25 bp, Homo sapiens
ccggggagacgtcttagacagtcgt

SEQ ID NO: 2947 - DNA, 25 bp, Homo sapiens
cggggagacgtcttagacagtcgtg

SEQ ID NO: 2948 - DNA, 25 bp, Homo sapiens
ggggagacgtcttagacagtcgtgg

SEQ ID NO: 2949 - DNA, 25 bp, Homo sapiens
gggagacgtcttagacagtcgtggt

SEQ ID NO: 2950 - DNA, 25 bp, Homo sapiens
ggagacgtcttagacagtcgtggtt

SEQ ID NO: 2951 - DNA, 25 bp, Homo sapiens
gagacgtcttagacagtcgtggttc

SEQ ID NO: 2952 - DNA, 25 bp, Homo sapiens
agacgtcttagacagtcgtggttcc

SEQ ID NO: 2953 - DNA, 25 bp, Homo sapiens
gacgtcttagacagtcgtggttcct

SEQ ID NO: 2954 - DNA, 25 bp, Homo sapiens
acgtcttagacagtcgtggttcctg

SEQ ID NO: 2955 - DNA, 25 bp, Homo sapiens
cgtcttagacagtcgtggttcctgt

SEQ ID NO: 2956 - DNA, 25 bp, Homo sapiens
gtcttagacagtcgtggttcctgtg

SEQ ID NO: 2957 - DNA, 25 bp, Homo sapiens
tcttagacagtcgtggttcctgtga

SEQ ID NO: 2958 - DNA, 25 bp, Homo sapiens
cttagacagtcgtggttcctgtgat

SEQ ID NO: 2959 - DNA, 25 bp, Homo sapiens
ttagacagtcgtggttcctgtgatc

SEQ ID NO: 2960 - DNA, 25 bp, Homo sapiens
tagacagtcgtggttcctgtgatct

SEQ ID NO: 2961 - DNA, 25 bp, Homo sapiens
agacagtcgtggttcctgtgatctg

SEQ ID NO: 2962 - DNA, 25 bp, Homo sapiens
gacagtcgtggttcctgtgatctgt

SEQ ID NO: 2963 - DNA, 25 bp, Homo sapiens
acagtcgtggttcctgtgatctgtg

SEQ ID NO: 2964 - DNA, 25 bp, Homo sapiens
cagtcgtggttcctgtgatctgtgt

SEQ ID NO: 2965 - DNA, 25 bp, Homo sapiens
agtcgtggttcctgtgatctgtgtc

SEQ ID NO: 2966 - DNA, 25 bp, Homo sapiens
gtcgtggttcctgtgatctgtgtcc

SEQ ID NO: 2967 - DNA, 25 bp, Homo sapiens
tcgtggttcctgtgatctgtgtcct

SEQ ID NO: 2968 - DNA, 25 bp, Homo sapiens
cgtggttcctgtgatctgtgtcctc

SEQ ID NO: 2969 - DNA, 25 bp, Homo sapiens
gtggttcctgtgatctgtgtcctct

SEQ ID NO: 2970 - DNA, 25 bp, Homo sapiens
tggttcctgtgatctgtgtcctctt

SEQ ID NO: 2971 - DNA, 25 bp, Homo sapiens
ggttcctgtgatctgtgtcctcttt

SEQ ID NO: 2972 - DNA, 25 bp, Homo sapiens
gttcctgtgatctgtgtcctctttg

SEQ ID NO: 2973 - DNA, 25 bp, Homo sapiens
ttcctgtgatctgtgtcctctttgc

SEQ ID NO: 2974 - DNA, 25 bp, Homo sapiens
tcctgtgatctgtgtcctctttgca

SEQ ID NO: 2975 - DNA, 25 bp, Homo sapiens
cctgtgatctgtgtcctctttgcag

SEQ ID NO: 2976 - DNA, 25 bp, Homo sapiens
ctgtgatctgtgtcctctttgcaga

SEQ ID NO: 2977 - DNA, 25 bp, Homo sapiens
tgtgatctgtgtcctctttgcagaa

SEQ ID NO: 2978 - DNA, 25 bp, Homo sapiens
gtgatctgtgtcctctttgcagaag

SEQ ID NO: 2979 - DNA, 25 bp, Homo sapiens
tgatctgtgtcctctttgcagaagt

SEQ ID NO: 2980 - DNA, 25 bp, Homo sapiens
gatctgtgtcctctttgcagaagtt

SEQ ID NO: 2981 - DNA, 25 bp, Homo sapiens
atctgtgtcctctttgcagaagttc

SEQ ID NO: 2982 - DNA, 25 bp, Homo sapiens
tctgtgtcctctttgcagaagttct

SEQ ID NO: 2983 - DNA, 25 bp, Homo sapiens
ctgtgtcctctttgcagaagttctg

SEQ ID NO: 2984 - DNA, 25 bp, Homo sapiens
tgtgtcctctttgcagaagttctgt

SEQ ID NO: 2985 - DNA, 25 bp, Homo sapiens
gtgtcctctttgcagaagttctgtg

SEQ ID NO: 2986 - DNA, 25 bp, Homo sapiens
tgtcctctttgcagaagttctgtgt

SEQ ID NO: 2987 - DNA, 25 bp, Homo sapiens
gtcctctttgcagaagttctgtgtc

SEQ ID NO: 2988 - DNA, 25 bp, Homo sapiens
tcctctttgcagaagttctgtgtcc

SEQ ID NO: 2989 - DNA, 25 bp, Homo sapiens
cctctttgcagaagttctgtgtcca

SEQ ID NO: 2990 - DNA, 25 bp, Homo sapiens
ctctttgcagaagttctgtgtccat

SEQ ID NO: 2991 - DNA, 25 bp, Homo sapiens
tctttgcagaagttctgtgtccatc

SEQ ID NO: 2992 - DNA, 25 bp, Homo sapiens
ctttgcagaagttctgtgtccatct

SEQ ID NO: 2993 - DNA, 25 bp, Homo sapiens
tttgcagaagttctgtgtccatctc

SEQ ID NO: 2994 - DNA, 25 bp, Homo sapiens
ttgcagaagttctgtgtccatctca

SEQ ID NO: 2995 - DNA, 25 bp, Homo sapiens
tgcagaagttctgtgtccatctcat

SEQ ID NO: 2996 - DNA, 25 bp, Homo sapiens
gcagaagttctgtgtccatctcatg

SEQ ID NO: 2997 - DNA, 25 bp, Homo sapiens
cagaagttctgtgtccatctcatgt

SEQ ID NO: 2998 - DNA, 25 bp, Homo sapiens
agaagttctgtgtccatctcatgtg

SEQ ID NO: 2999 - DNA, 25 bp, Homo sapiens
gaagttctgtgtccatctcatgtgc

SEQ ID NO: 3000 - DNA, 25 bp, Homo sapiens
aagttctgtgtccatctcatgtgct

SEQ ID NO: 3001 - DNA, 25 bp, Homo sapiens
agttctgtgtccatctcatgtgctg

SEQ ID NO: 3002 - DNA, 25 bp, Homo sapiens
gttctgtgtccatctcatgtgctgc

SEQ ID NO: 3003 - DNA, 25 bp, Homo sapiens
ttctgtgtccatctcatgtgctgcg

SEQ ID NO: 3004 - DNA, 25 bp, Homo sapiens
tctgtgtccatctcatgtgctgcgt

SEQ ID NO: 3005 - DNA, 25 bp, Homo sapiens
ctgtgtccatctcatgtgctgcgtg

SEQ ID NO: 3006 - DNA, 25 bp, Homo sapiens
tgtgtccatctcatgtgctgcgtgt

SEQ ID NO: 3007 - DNA, 25 bp, Homo sapiens
gtgtccatctcatgtgctgcgtgtg

SEQ ID NO: 3008 - DNA, 25 bp, Homo sapiens
tgtccatctcatgtgctgcgtgtgt

SEQ ID NO: 3009 - DNA, 25 bp, Homo sapiens
gtccatctcatgtgctgcgtgtgtc

SEQ ID NO: 3010 - DNA, 25 bp, Homo sapiens
tccatctcatgtgctgcgtgtgtct

SEQ ID NO: 3011 - DNA, 25 bp, Homo sapiens
ccatctcatgtgctgcgtgtgtctg

SEQ ID NO: 3012 - DNA, 25 bp, Homo sapiens
catctcatgtgctgcgtgtgtctgt

SEQ ID NO: 3013 - DNA, 25 bp, Homo sapiens
atctcatgtgctgcgtgtgtctgta

SEQ ID NO: 3014 - DNA, 25 bp, Homo sapiens
tctcatgtgctgcgtgtgtctgtaa

SEQ ID NO: 3015 - DNA, 25 bp, Homo sapiens
ctcatgtgctgcgtgtgtctgtaaa

SEQ ID NO: 3016 - DNA, 25 bp, Homo sapiens
tcatgtgctgcgtgtgtctgtaaag

SEQ ID NO: 3017 - DNA, 25 bp, Homo sapiens
catgtgctgcgtgtgtctgtaaagc

SEQ ID NO: 3018 - DNA, 25 bp, Homo sapiens
atgtgctgcgtgtgtctgtaaagcc

SEQ ID NO: 3019 - DNA, 25 bp, Homo sapiens
tgtgctgcgtgtgtctgtaaagcct

SEQ ID NO: 3020 - DNA, 25 bp, Homo sapiens
gtgctgcgtgtgtctgtaaagcctc

SEQ ID NO: 3021 - DNA, 25 bp, Homo sapiens
tgctgcgtgtgtctgtaaagcctca

SEQ ID NO: 3022 - DNA, 25 bp, Homo sapiens
gctgcgtgtgtctgtaaagcctcat

SEQ ID NO: 3023 - DNA, 25 bp, Homo sapiens
ctgcgtgtgtctgtaaagcctcatt

SEQ ID NO: 3024 - DNA, 25 bp, Homo sapiens
tgcgtgtgtctgtaaagcctcattc

SEQ ID NO: 3025 - DNA, 25 bp, Homo sapiens
gcgtgtgtctgtaaagcctcattcc

SEQ ID NO: 3026 - DNA, 25 bp, Homo sapiens
cgtgtgtctgtaaagcctcattccg

SEQ ID NO: 3027 - DNA, 25 bp, Homo sapiens
gtgtgtctgtaaagcctcattccgt

SEQ ID NO: 3028 - DNA, 25 bp, Homo sapiens
tgtgtctgtaaagcctcattccgtg

SEQ ID NO: 3029 - DNA, 25 bp, Homo sapiens
gtgtctgtaaagcctcattccgtgc

SEQ ID NO: 3030 - DNA, 25 bp, Homo sapiens
tgtctgtaaagcctcattccgtgct

SEQ ID NO: 3031 - DNA, 25 bp, Homo sapiens
gtctgtaaagcctcattccgtgctg

SEQ ID NO: 3032 - DNA, 25 bp, Homo sapiens
tctgtaaagcctcattccgtgctgt

SEQ ID NO: 3033 - DNA, 25 bp, Homo sapiens
ctgtaaagcctcattccgtgctgtc

SEQ ID NO: 3034 - DNA, 25 bp, Homo sapiens
tgtaaagcctcattccgtgctgtct

SEQ ID NO: 3035 - DNA, 25 bp, Homo sapiens
gtaaagcctcattccgtgctgtctg

SEQ ID NO: 3036 - DNA, 25 bp, Homo sapiens
taaagcctcattccgtgctgtctgg

SEQ ID NO: 3037 - DNA, 25 bp, Homo sapiens
aaagcctcattccgtgctgtctggc

SEQ ID NO: 3038 - DNA, 25 bp, Homo sapiens
aagcctcattccgtgctgtctggca

SEQ ID NO: 3039 - DNA, 25 bp, Homo sapiens
agcctcattccgtgctgtctggcag

SEQ ID NO: 3040 - DNA, 25 bp, Homo sapiens
gcctcattccgtgctgtctggcagg

SEQ ID NO: 3041 - DNA, 25 bp, Homo sapiens
cctcattccgtgctgtctggcagga

SEQ ID NO: 3042 - DNA, 25 bp, Homo sapiens
ctcattccgtgctgtctggcaggaa

SEQ ID NO: 3043 - DNA, 25 bp, Homo sapiens
tcattccgtgctgtctggcaggaag

SEQ ID NO: 3044 - DNA, 25 bp, Homo sapiens
cattccgtgctgtctggcaggaagc

SEQ ID NO: 3045 - DNA, 25 bp, Homo sapiens
attccgtgctgtctggcaggaagct

SEQ ID NO: 3046 - DNA, 25 bp, Homo sapiens
ttccgtgctgtctggcaggaagctc

SEQ ID NO: 3047 - DNA, 25 bp, Homo sapiens
tccgtgctgtctggcaggaagctcc

SEQ ID NO: 3048 - DNA, 25 bp, Homo sapiens
ccgtgctgtctggcaggaagctcca

SEQ ID NO: 3049 - DNA, 25 bp, Homo sapiens
cgtgctgtctggcaggaagctccat

SEQ ID NO: 3050 - DNA, 25 bp, Homo sapiens
gtgctgtctggcaggaagctccatc

SEQ ID NO: 3051 - DNA, 25 bp, Homo sapiens
tgctgtctggcaggaagctccatct

SEQ ID NO: 3052 - DNA, 25 bp, Homo sapiens
gctgtctggcaggaagctccatctc

SEQ ID NO: 3053 - DNA, 25 bp, Homo sapiens
ctgtctggcaggaagctccatctca

SEQ ID NO: 3054 - DNA, 25 bp, Homo sapiens
tgtctggcaggaagctccatctcat

SEQ ID NO: 3055 - DNA, 25 bp, Homo sapiens
gtctggcaggaagctccatctcatc

SEQ ID NO: 3056 - DNA, 25 bp, Homo sapiens
tctggcaggaagctccatctcatct

SEQ ID NO: 3057 - DNA, 25 bp, Homo sapiens
ctggcaggaagctccatctcatctc

SEQ ID NO: 3058 - DNA, 25 bp, Homo sapiens
tggcaggaagctccatctcatctca

SEQ ID NO: 3059 - DNA, 25 bp, Homo sapiens
ggcaggaagctccatctcatctcat

SEQ ID NO: 3060 - DNA, 25 bp, Homo sapiens
gcaggaagctccatctcatctcatc

SEQ ID NO: 3061 - DNA, 25 bp, Homo sapiens
caggaagctccatctcatctcatca

SEQ ID NO: 3062 - DNA, 25 bp, Homo sapiens
aggaagctccatctcatctcatcat

SEQ ID NO: 3063 - DNA, 25 bp, Homo sapiens
ggaagctccatctcatctcatcatc

SEQ ID NO: 3064 - DNA, 25 bp, Homo sapiens
gaagctccatctcatctcatcatct

SEQ ID NO: 3065 - DNA, 25 bp, Homo sapiens
aagctccatctcatctcatcatctc

SEQ ID NO: 3066 - DNA, 25 bp, Homo sapiens
agctccatctcatctcatcatctca

SEQ ID NO: 3067 - DNA, 25 bp, Homo sapiens
gctccatctcatctcatcatctcac

SEQ ID NO: 3068 - DNA, 25 bp, Homo sapiens
ctccatctcatctcatcatctcacg

SEQ ID NO: 3069 - DNA, 25 bp, Homo sapiens
tccatctcatctcatcatctcacgg

SEQ ID NO: 3070 - DNA, 25 bp, Homo sapiens
ccatctcatctcatcatctcacggc

SEQ ID NO: 3071 - DNA, 25 bp, Homo sapiens
catctcatctcatcatctcacggcc

SEQ ID NO: 3072 - DNA, 25 bp, Homo sapiens
atctcatctcatcatctcacggccc

SEQ ID NO: 3073 - DNA, 25 bp, Homo sapiens
tctcatctcatcatctcacggccct

SEQ ID NO: 3074 - DNA, 25 bp, Homo sapiens
ctcatctcatcatctcacggccctg

SEQ ID NO: 3075 - DNA, 25 bp, Homo sapiens
tcatctcatcatctcacggccctgg

SEQ ID NO: 3076 - DNA, 25 bp, Homo sapiens
catctcatcatctcacggccctggc

SEQ ID NO: 3077 - DNA, 25 bp, Homo sapiens
atctcatcatctcacggccctggca

SEQ ID NO: 3078 - DNA, 25 bp, Homo sapiens
tctcatcatctcacggccctggcac

SEQ ID NO: 3079 - DNA, 25 bp, Homo sapiens
ctcatcatctcacggccctggcact

SEQ ID NO: 3080 - DNA, 25 bp, Homo sapiens
tcatcatctcacggccctggcactg

SEQ ID NO: 3081 - DNA, 25 bp, Homo sapiens
catcatctcacggccctggcactgc

SEQ ID NO: 3082 - DNA, 25 bp, Homo sapiens
atcatctcacggccctggcactgcc

SEQ ID NO: 3083 - DNA, 25 bp, Homo sapiens
tcatctcacggccctggcactgcct

SEQ ID NO: 3084 - DNA, 25 bp, Homo sapiens
catctcacggccctggcactgcctc

SEQ ID NO: 3085 - DNA, 25 bp, Homo sapiens
atctcacggccctggcactgcctca

SEQ ID NO: 3086 - DNA, 25 bp, Homo sapiens
tctcacggccctggcactgcctcag

SEQ ID NO: 3087 - DNA, 25 bp, Homo sapiens
ctcacggccctggcactgcctcagc

SEQ ID NO: 3088 - DNA, 25 bp, Homo sapiens
tcacggccctggcactgcctcagca

SEQ ID NO: 3089 - DNA, 25 bp, Homo sapiens
cacggccctggcactgcctcagcat

SEQ ID NO: 3090 - DNA, 25 bp, Homo sapiens
acggccctggcactgcctcagcatg

SEQ ID NO: 3091 - DNA, 25 bp, Homo sapiens
cggccctggcactgcctcagcatgg

SEQ ID NO: 3092 - DNA, 25 bp, Homo sapiens
ggccctggcactgcctcagcatggc

SEQ ID NO: 3093 - DNA, 25 bp, Homo sapiens
gccctggcactgcctcagcatggcc

SEQ ID NO: 3094 - DNA, 25 bp, Homo sapiens
ccctggcactgcctcagcatggcca

SEQ ID NO: 3095 - DNA, 25 bp, Homo sapiens
cctggcactgcctcagcatggccat

SEQ ID NO: 3096 - DNA, 25 bp, Homo sapiens
ctggcactgcctcagcatggccatc

SEQ ID NO: 3097 - DNA, 25 bp, Homo sapiens
tggcactgcctcagcatggccatct

SEQ ID NO: 3098 - DNA, 25 bp, Homo sapiens
ggcactgcctcagcatggccatctc

SEQ ID NO: 3099 - DNA, 25 bp, Homo sapiens
gcactgcctcagcatggccatctca

SEQ ID NO: 3100 - DNA, 25 bp, Homo sapiens
cactgcctcagcatggccatctcat

SEQ ID NO: 3101 - DNA, 25 bp, Homo sapiens
actgcctcagcatggccatctcatc

SEQ ID NO: 3102 - DNA, 25 bp, Homo sapiens
ctgcctcagcatggccatctcatca

SEQ ID NO: 3103 - DNA, 25 bp, Homo sapiens
tgcctcagcatggccatctcatcac

SEQ ID NO: 3104 - DNA, 25 bp, Homo sapiens
gcctcagcatggccatctcatcacg

SEQ ID NO: 3105 - DNA, 25 bp, Homo sapiens
cctcagcatggccatctcatcacgc

SEQ ID NO: 3106 - DNA, 25 bp, Homo sapiens
ctcagcatggccatctcatcacgcc

SEQ ID NO: 3107 - DNA, 25 bp, Homo sapiens
tcagcatggccatctcatcacgcct

SEQ ID NO: 3108 - DNA, 25 bp, Homo sapiens
cagcatggccatctcatcacgcctc

SEQ ID NO: 3109 - DNA, 25 bp, Homo sapiens
agcatggccatctcatcacgcctcg

SEQ ID NO: 3110 - DNA, 25 bp, Homo sapiens
gcatggccatctcatcacgcctcgc

SEQ ID NO: 3111 - DNA, 25 bp, Homo sapiens
catggccatctcatcacgcctcgcc

SEQ ID NO: 3112 - DNA, 25 bp, Homo sapiens
atggccatctcatcacgcctcgccc

SEQ ID NO: 3113 - DNA, 25 bp, Homo sapiens
tggccatctcatcacgcctcgccct

SEQ ID NO: 3114 - DNA, 25 bp, Homo sapiens
ggccatctcatcacgcctcgccctg

SEQ ID NO: 3115 - DNA, 25 bp, Homo sapiens
gccatctcatcacgcctcgccctgt

SEQ ID NO: 3116 - DNA, 25 bp, Homo sapiens
ccatctcatcacgcctcgccctgtg

SEQ ID NO: 3117 - DNA, 25 bp, Homo sapiens
catctcatcacgcctcgccctgtgg

SEQ ID NO: 3118 - DNA, 25 bp, Homo sapiens
atctcatcacgcctcgccctgtggg

SEQ ID NO: 3119 - DNA, 25 bp, Homo sapiens
tctcatcacgcctcgccctgtggga

SEQ ID NO: 3120 - DNA, 25 bp, Homo sapiens
ctcatcacgcctcgccctgtgggag

SEQ ID NO: 3121 - DNA, 25 bp, Homo sapiens
tcatcacgcctcgccctgtgggagc

SEQ ID NO: 3122 - DNA, 25 bp, Homo sapiens
catcacgcctcgccctgtgggagca

SEQ ID NO: 3123 - DNA, 25 bp, Homo sapiens
atcacgcctcgccctgtgggagcag

SEQ ID NO: 3124 - DNA, 25 bp, Homo sapiens
tcacgcctcgccctgtgggagcaga

SEQ ID NO: 3125 - DNA, 25 bp, Homo sapiens
cacgcctcgccctgtgggagcagaa

SEQ ID NO: 3126 - DNA, 25 bp, Homo sapiens
acgcctcgccctgtgggagcagaag

SEQ ID NO: 3127 - DNA, 25 bp, Homo sapiens
cgcctcgccctgtgggagcagaaga

SEQ ID NO: 3128 - DNA, 25 bp, Homo sapiens
gcctcgccctgtgggagcagaagat

SEQ ID NO: 3129 - DNA, 25 bp, Homo sapiens
cctcgccctgtgggagcagaagatt

SEQ ID NO: 3130 - DNA, 25 bp, Homo sapiens
ctcgccctgtgggagcagaagattc

SEQ ID NO: 3131 - DNA, 25 bp, Homo sapiens
tcgccctgtgggagcagaagattcg

SEQ ID NO: 3132 - DNA, 25 bp, Homo sapiens
cgccctgtgggagcagaagattcgg

SEQ ID NO: 3133 - DNA, 25 bp, Homo sapiens
gccctgtgggagcagaagattcggg

SEQ ID NO: 3134 - DNA, 25 bp, Homo sapiens
ccctgtgggagcagaagattcggga

SEQ ID NO: 3135 - DNA, 25 bp, Homo sapiens
cctgtgggagcagaagattcgggaa

SEQ ID NO: 3136 - DNA, 25 bp, Homo sapiens
ctgtgggagcagaagattcgggaag

SEQ ID NO: 3137 - DNA, 25 bp, Homo sapiens
tgtgggagcagaagattcgggaaga

SEQ ID NO: 3138 - DNA, 25 bp, Homo sapiens
gtgggagcagaagattcgggaagag

SEQ ID NO: 3139 - DNA, 25 bp, Homo sapiens
tgggagcagaagattcgggaagagg

SEQ ID NO: 3140 - DNA, 25 bp, Homo sapiens
gggagcagaagattcgggaagagga

SEQ ID NO: 3141 - DNA, 25 bp, Homo sapiens
ggagcagaagattcgggaagaggac

SEQ ID NO: 3142 - DNA, 25 bp, Homo sapiens
gagcagaagattcgggaagaggaca

SEQ ID NO: 3143 - DNA, 25 bp, Homo sapiens
agcagaagattcgggaagaggacaa

SEQ ID NO: 3144 - DNA, 25 bp, Homo sapiens
gcagaagattcgggaagaggacaag

SEQ ID NO: 3145 - DNA, 25 bp, Homo sapiens
cagaagattcgggaagaggacaaga

SEQ ID NO: 3146 - DNA, 25 bp, Homo sapiens
agaagattcgggaagaggacaagag

SEQ ID NO: 3147 - DNA, 25 bp, Homo sapiens
gaagattcgggaagaggacaagagc

SEQ ID NO: 3148 - DNA, 25 bp, Homo sapiens
aagattcgggaagaggacaagagcc

SEQ ID NO: 3149 - DNA, 25 bp, Homo sapiens
agattcgggaagaggacaagagccc

SEQ ID NO: 3150 - DNA, 25 bp, Homo sapiens
gattcgggaagaggacaagagccct

SEQ ID NO: 3151 - DNA, 25 bp, Homo sapiens
attcgggaagaggacaagagccctc

SEQ ID NO: 3152 - DNA, 25 bp, Homo sapiens
ttcgggaagaggacaagagccctcc

SEQ ID NO: 3153 - DNA, 25 bp, Homo sapiens
tcgggaagaggacaagagccctcca

SEQ ID NO: 3154 - DNA, 25 bp, Homo sapiens
cgggaagaggacaagagccctccac

SEQ ID NO: 3155 - DNA, 25 bp, Homo sapiens
gggaagaggacaagagccctccacc

SEQ ID NO: 3156 - DNA, 25 bp, Homo sapiens
ggaagaggacaagagccctccacca

SEQ ID NO: 3157 - DNA, 25 bp, Homo sapiens
gaagaggacaagagccctccaccat

SEQ ID NO: 3158 - DNA, 25 bp, Homo sapiens
aagaggacaagagccctccaccatc

SEQ ID NO: 3159 - DNA, 25 bp, Homo sapiens
agaggacaagagccctccaccatcc

SEQ ID NO: 3160 - DNA, 25 bp, Homo sapiens
gaggacaagagccctccaccatcct

SEQ ID NO: 3161 - DNA, 25 bp, Homo sapiens
aggacaagagccctccaccatcctc

SEQ ID NO: 3162 - DNA, 25 bp, Homo sapiens
ggacaagagccctccaccatcctcg

SEQ ID NO: 3163 - DNA, 25 bp, Homo sapiens
gacaagagccctccaccatcctcgc

SEQ ID NO: 3164 - DNA, 25 bp, Homo sapiens
acaagagccctccaccatcctcgcc

SEQ ID NO: 3165 - DNA, 25 bp, Homo sapiens
caagagccctccaccatcctcgccc

SEQ ID NO: 3166 - DNA, 25 bp, Homo sapiens
aagagccctccaccatcctcgcccc

SEQ ID NO: 3167 - DNA, 25 bp, Homo sapiens
agagccctccaccatcctcgccccc

SEQ ID NO: 3168 - DNA, 25 bp, Homo sapiens
gagccctccaccatcctcgccccct

SEQ ID NO: 3169 - DNA, 25 bp, Homo sapiens
agccctccaccatcctcgccccctc

SEQ ID NO: 3170 - DNA, 25 bp, Homo sapiens
gccctccaccatcctcgccccctcc

SEQ ID NO: 3171 - DNA, 25 bp, Homo sapiens
ccctccaccatcctcgccccctcct

SEQ ID NO: 3172 - DNA, 25 bp, Homo sapiens
cctccaccatcctcgccccctcctc

SEQ ID NO: 3173 - DNA, 25 bp, Homo sapiens
ctccaccatcctcgccccctcctct

SEQ ID NO: 3174 - DNA, 25 bp, Homo sapiens
tccaccatcctcgccccctcctctt

SEQ ID NO: 3175 - DNA, 25 bp, Homo sapiens
ccaccatcctcgccccctcctcttt

SEQ ID NO: 3176 - DNA, 25 bp, Homo sapiens
caccatcctcgccccctcctctttt

SEQ ID NO: 3177 - DNA, 25 bp, Homo sapiens
accatcctcgccccctcctcttttc

SEQ ID NO: 3178 - DNA, 25 bp, Homo sapiens
ccatcctcgccccctcctcttttct

SEQ ID NO: 3179 - DNA, 25 bp, Homo sapiens
catcctcgccccctcctcttttctc

SEQ ID NO: 3180 - DNA, 25 bp, Homo sapiens
atcctcgccccctcctcttttctct

SEQ ID NO: 3181 - DNA, 25 bp, Homo sapiens
tcctcgccccctcctcttttctctg

SEQ ID NO: 3182 - DNA, 25 bp, Homo sapiens
cctcgccccctcctcttttctctgt

SEQ ID NO: 3183 - DNA, 25 bp, Homo sapiens
ctcgccccctcctcttttctctgtc

SEQ ID NO: 3184 - DNA, 25 bp, Homo sapiens
tcgccccctcctcttttctctgtca

SEQ ID NO: 3185 - DNA, 25 bp, Homo sapiens
cgccccctcctcttttctctgtcat

SEQ ID NO: 3186 - DNA, 25 bp, Homo sapiens
gccccctcctcttttctctgtcatc

SEQ ID NO: 3187 - DNA, 25 bp, Homo sapiens
ccccctcctcttttctctgtcatcc

SEQ ID NO: 3188 - DNA, 25 bp, Homo sapiens
cccctcctcttttctctgtcatccc

SEQ ID NO: 3189 - DNA, 25 bp, Homo sapiens
ccctcctcttttctctgtcatccca

SEQ ID NO: 3190 - DNA, 25 bp, Homo sapiens
cctcctcttttctctgtcatcccag

SEQ ID NO: 3191 - DNA, 25 bp, Homo sapiens
ctcctcttttctctgtcatcccagg

SEQ ID NO: 3192 - DNA, 25 bp, Homo sapiens
tcctcttttctctgtcatcccaggg

SEQ ID NO: 3193 - DNA, 25 bp, Homo sapiens
cctcttttctctgtcatcccagggg

SEQ ID NO: 3194 - DNA, 25 bp, Homo sapiens
ctcttttctctgtcatcccaggggg

SEQ ID NO: 3195 - DNA, 25 bp, Homo sapiens
tcttttctctgtcatcccagggggc

SEQ ID NO: 3196 - DNA, 25 bp, Homo sapiens
cttttctctgtcatcccagggggct

SEQ ID NO: 3197 - DNA, 25 bp, Homo sapiens
ttttctctgtcatcccagggggctt

SEQ ID NO: 3198 - DNA, 25 bp, Homo sapiens
tttctctgtcatcccagggggcttc

SEQ ID NO: 3199 - DNA, 25 bp, Homo sapiens
ttctctgtcatcccagggggcttca

SEQ ID NO: 3200 - DNA, 25 bp, Homo sapiens
tctctgtcatcccagggggcttcat

SEQ ID NO: 3201 - DNA, 25 bp, Homo sapiens
ctctgtcatcccagggggcttcatt

SEQ ID NO: 3202 - DNA, 25 bp, Homo sapiens
tctgtcatcccagggggcttcatta

SEQ ID NO: 3203 - DNA, 25 bp, Homo sapiens
ctgtcatcccagggggcttcattaa

SEQ ID NO: 3204 - DNA, 25 bp, Homo sapiens
tgtcatcccagggggcttcattaag

SEQ ID NO: 3205 - DNA, 25 bp, Homo sapiens
gtcatcccagggggcttcattaagc

SEQ ID NO: 3206 - DNA, 25 bp, Homo sapiens
tcatcccagggggcttcattaagca

SEQ ID NO: 3207 - DNA, 25 bp, Homo sapiens
catcccagggggcttcattaagcaa

SEQ ID NO: 3208 - DNA, 25 bp, Homo sapiens
atcccagggggcttcattaagcaac

SEQ ID NO: 3209 - DNA, 25 bp, Homo sapiens
tcccagggggcttcattaagcaact

SEQ ID NO: 3210 - DNA, 25 bp, Homo sapiens
cccagggggcttcattaagcaactg

SEQ ID NO: 3211 - DNA, 25 bp, Homo sapiens
ccagggggcttcattaagcaactgg

SEQ ID NO: 3212 - DNA, 25 bp, Homo sapiens
cagggggcttcattaagcaactggt

SEQ ID NO: 3213 - DNA, 25 bp, Homo sapiens
agggggcttcattaagcaactggtc

SEQ ID NO: 3214 - DNA, 25 bp, Homo sapiens
gggggcttcattaagcaactggtcc

SEQ ID NO: 3215 - DNA, 25 bp, Homo sapiens
ggggcttcattaagcaactggtccg

SEQ ID NO: 3216 - DNA, 25 bp, Homo sapiens
gggcttcattaagcaactggtccgg

SEQ ID NO: 3217 - DNA, 25 bp, Homo sapiens
ggcttcattaagcaactggtccggg

SEQ ID NO: 3218 - DNA, 25 bp, Homo sapiens
gcttcattaagcaactggtccgggg

SEQ ID NO: 3219 - DNA, 25 bp, Homo sapiens
cttcattaagcaactggtccggggg

SEQ ID NO: 3220 - DNA, 25 bp, Homo sapiens
ttcattaagcaactggtccggggga

SEQ ID NO: 3221 - DNA, 25 bp, Homo sapiens
tcattaagcaactggtccgggggac

SEQ ID NO: 3222 - DNA, 25 bp, Homo sapiens
cattaagcaactggtccgggggact

SEQ ID NO: 3223 - DNA, 25 bp, Homo sapiens
attaagcaactggtccgggggactg

SEQ ID NO: 3224 - DNA, 25 bp, Homo sapiens
ttaagcaactggtccgggggactga

SEQ ID NO: 3225 - DNA, 25 bp, Homo sapiens
taagcaactggtccgggggactgaa

SEQ ID NO: 3226 - DNA, 25 bp, Homo sapiens
aagcaactggtccgggggactgaaa

SEQ ID NO: 3227 - DNA, 25 bp, Homo sapiens
agcaactggtccgggggactgaaaa

SEQ ID NO: 3228 - DNA, 25 bp, Homo sapiens
gcaactggtccgggggactgaaaaa

SEQ ID NO: 3229 - DNA, 25 bp, Homo sapiens
caactggtccgggggactgaaaaag

SEQ ID NO: 3230 - DNA, 25 bp, Homo sapiens
aactggtccgggggactgaaaaaga

SEQ ID NO: 3231 - DNA, 25 bp, Homo sapiens
actggtccgggggactgaaaaagag

SEQ ID NO: 3232 - DNA, 25 bp, Homo sapiens
ctggtccgggggactgaaaaagagg

SEQ ID NO: 3233 - DNA, 25 bp, Homo sapiens
tggtccgggggactgaaaaagaggc

SEQ ID NO: 3234 - DNA, 25 bp, Homo sapiens
ggtccgggggactgaaaaagaggcc

SEQ ID NO: 3235 - DNA, 25 bp, Homo sapiens
gtccgggggactgaaaaagaggcca

SEQ ID NO: 3236 - DNA, 25 bp, Homo sapiens
tccgggggactgaaaaagaggccaa

SEQ ID NO: 3237 - DNA, 25 bp, Homo sapiens
ccgggggactgaaaaagaggccaag

SEQ ID NO: 3238 - DNA, 25 bp, Homo sapiens
cgggggactgaaaaagaggccaagg

SEQ ID NO: 3239 - DNA, 25 bp, Homo sapiens
gggggactgaaaaagaggccaagga

SEQ ID NO: 3240 - DNA, 25 bp, Homo sapiens
ggggactgaaaaagaggccaaggaa

SEQ ID NO: 3241 - DNA, 25 bp, Homo sapiens
gggactgaaaaagaggccaaggaag

SEQ ID NO: 3242 - DNA, 25 bp, Homo sapiens
ggactgaaaaagaggccaaggaagc

SEQ ID NO: 3243 - DNA, 25 bp, Homo sapiens
gactgaaaaagaggccaaggaagcg

SEQ ID NO: 3244 - DNA, 25 bp, Homo sapiens
actgaaaaagaggccaaggaagcga

SEQ ID NO: 3245 - DNA, 25 bp, Homo sapiens
ctgaaaaagaggccaaggaagcgag

SEQ ID NO: 3246 - DNA, 25 bp, Homo sapiens
tgaaaaagaggccaaggaagcgaga

SEQ ID NO: 3247 - DNA, 25 bp, Homo sapiens
gaaaaagaggccaaggaagcgagac

SEQ ID NO: 3248 - DNA, 25 bp, Homo sapiens
aaaaagaggccaaggaagcgagaca

SEQ ID NO: 3249 - DNA, 25 bp, Homo sapiens
aaaagaggccaaggaagcgagacag

SEQ ID NO: 3250 - DNA, 25 bp, Homo sapiens
aaagaggccaaggaagcgagacaga

SEQ ID NO: 3251 - DNA, 25 bp, Homo sapiens
aagaggccaaggaagcgagacagag

SEQ ID NO: 3252 - DNA, 25 bp, Homo sapiens
agaggccaaggaagcgagacagagg

SEQ ID NO: 3253 - DNA, 25 bp, Homo sapiens
gaggccaaggaagcgagacagagga

SEQ ID NO: 3254 - DNA, 25 bp, Homo sapiens
aggccaaggaagcgagacagaggaa

SEQ ID NO: 3255 - DNA, 25 bp, Homo sapiens
ggccaaggaagcgagacagaggaag

SEQ ID NO: 3256 - DNA, 25 bp, Homo sapiens
gccaaggaagcgagacagaggaagc

SEQ ID NO: 3257 - DNA, 25 bp, Homo sapiens
ccaaggaagcgagacagaggaagca

SEQ ID NO: 3258 - DNA, 25 bp, Homo sapiens
caaggaagcgagacagaggaagcag

SEQ ID NO: 3259 - DNA, 25 bp, Homo sapiens
aaggaagcgagacagaggaagcagt

SEQ ID NO: 3260 - DNA, 25 bp, Homo sapiens
aggaagcgagacagaggaagcagtt

SEQ ID NO: 3261 - DNA, 25 bp, Homo sapiens
ggaagcgagacagaggaagcagtta

SEQ ID NO: 3262 - DNA, 25 bp, Homo sapiens
gaagcgagacagaggaagcagttag

SEQ ID NO: 3263 - DNA, 25 bp, Homo sapiens
aagcgagacagaggaagcagttagc

SEQ ID NO: 3264 - DNA, 25 bp, Homo sapiens
agcgagacagaggaagcagttagct

SEQ ID NO: 3265 - DNA, 25 bp, Homo sapiens
gcgagacagaggaagcagttagctg

SEQ ID NO: 3266 - DNA, 25 bp, Homo sapiens
cgagacagaggaagcagttagctgt

SEQ ID NO: 3267 - DNA, 25 bp, Homo sapiens
gagacagaggaagcagttagctgtc

SEQ ID NO: 3268 - DNA, 25 bp, Homo sapiens
agacagaggaagcagttagctgtcg

SEQ ID NO: 3269 - DNA, 25 bp, Homo sapiens
gacagaggaagcagttagctgtcgc

SEQ ID NO: 3270 - DNA, 25 bp, Homo sapiens
acagaggaagcagttagctgtcgcc

SEQ ID NO: 3271 - DNA, 25 bp, Homo sapiens
cagaggaagcagttagctgtcgcct

SEQ ID NO: 3272 - DNA, 25 bp, Homo sapiens
agaggaagcagttagctgtcgcctc

SEQ ID NO: 3273 - DNA, 25 bp, Homo sapiens
gaggaagcagttagctgtcgcctct

SEQ ID NO: 3274 - DNA, 25 bp, Homo sapiens
aggaagcagttagctgtcgcctctc

SEQ ID NO: 3275 - DNA, 25 bp, Homo sapiens
ggaagcagttagctgtcgcctctcc

SEQ ID NO: 3276 - DNA, 25 bp, Homo sapiens
gaagcagttagctgtcgcctctcca

SEQ ID NO: 3277 - DNA, 25 bp, Homo sapiens
aagcagttagctgtcgcctctccag

SEQ ID NO: 3278 - DNA, 25 bp, Homo sapiens
agcagttagctgtcgcctctccaga

SEQ ID NO: 3279 - DNA, 25 bp, Homo sapiens
gcagttagctgtcgcctctccagaa

SEQ ID NO: 3280 - DNA, 25 bp, Homo sapiens
cagttagctgtcgcctctccagaac

SEQ ID NO: 3281 - DNA, 25 bp, Homo sapiens
agttagctgtcgcctctccagaacg

SEQ ID NO: 3282 - DNA, 25 bp, Homo sapiens
gttagctgtcgcctctccagaacga

SEQ ID NO: 3283 - DNA, 25 bp, Homo sapiens
ttagctgtcgcctctccagaacgag

SEQ ID NO: 3284 - DNA, 25 bp, Homo sapiens
tagctgtcgcctctccagaacgaga

SEQ ID NO: 3285 - DNA, 25 bp, Homo sapiens
agctgtcgcctctccagaacgagag

SEQ ID NO: 3286 - DNA, 25 bp, Homo sapiens
gctgtcgcctctccagaacgagaga

SEQ ID NO: 3287 - DNA, 25 bp, Homo sapiens
ctgtcgcctctccagaacgagagat

SEQ ID NO: 3288 - DNA, 25 bp, Homo sapiens
tgtcgcctctccagaacgagagatc

SEQ ID NO: 3289 - DNA, 25 bp, Homo sapiens
gtcgcctctccagaacgagagatcc

SEQ ID NO: 3290 - DNA, 25 bp, Homo sapiens
tcgcctctccagaacgagagatccc

SEQ ID NO: 3291 - DNA, 25 bp, Homo sapiens
cgcctctccagaacgagagatccca

SEQ ID NO: 3292 - DNA, 25 bp, Homo sapiens
gcctctccagaacgagagatcccag

SEQ ID NO: 3293 - DNA, 25 bp, Homo sapiens
cctctccagaacgagagatcccaga

SEQ ID NO: 3294 - DNA, 25 bp, Homo sapiens
ctctccagaacgagagatcccagaa

SEQ ID NO: 3295 - DNA, 25 bp, Homo sapiens
tctccagaacgagagatcccagaaa

SEQ ID NO: 3296 - DNA, 25 bp, Homo sapiens
ctccagaacgagagatcccagaaat

SEQ ID NO: 3297 - DNA, 25 bp, Homo sapiens
tccagaacgagagatcccagaaatt

SEQ ID NO: 3298 - DNA, 25 bp, Homo sapiens
ccagaacgagagatcccagaaattt

SEQ ID NO: 3299 - DNA, 25 bp, Homo sapiens
cagaacgagagatcccagaaatttc

SEQ ID NO: 3300 - DNA, 25 bp, Homo sapiens
agaacgagagatcccagaaatttcc

SEQ ID NO: 3301 - DNA, 25 bp, Homo sapiens
gaacgagagatcccagaaatttcca

SEQ ID NO: 3302 - DNA, 25 bp, Homo sapiens
aacgagagatcccagaaatttccat

SEQ ID NO: 3303 - DNA, 25 bp, Homo sapiens
acgagagatcccagaaatttccatc

SEQ ID NO: 3304 - DNA, 25 bp, Homo sapiens
cgagagatcccagaaatttccatca

SEQ ID NO: 3305 - DNA, 25 bp, Homo sapiens
gagagatcccagaaatttccatcag

SEQ ID NO: 3306 - DNA, 25 bp, Homo sapiens
agagatcccagaaatttccatcagc

SEQ ID NO: 3307 - DNA, 25 bp, Homo sapiens
gagatcccagaaatttccatcagcc

SEQ ID NO: 3308 - DNA, 25 bp, Homo sapiens
agatcccagaaatttccatcagcca

SEQ ID NO: 3309 - DNA, 25 bp, Homo sapiens
gatcccagaaatttccatcagccaa

SEQ ID NO: 3310 - DNA, 25 bp, Homo sapiens
atcccagaaatttccatcagccaac

SEQ ID NO: 3311 - DNA, 25 bp, Homo sapiens
tcccagaaatttccatcagccaacc

SEQ ID NO: 3312 - DNA, 25 bp, Homo sapiens
cccagaaatttccatcagccaaccc

SEQ ID NO: 3313 - DNA, 25 bp, Homo sapiens
ccagaaatttccatcagccaaccca

SEQ ID NO: 3314 - DNA, 25 bp, Homo sapiens
cagaaatttccatcagccaacccaa

SEQ ID NO: 3315 - DNA, 25 bp, Homo sapiens
agaaatttccatcagccaacccaac

SEQ ID NO: 3316 - DNA, 25 bp, Homo sapiens
gaaatttccatcagccaacccaaca

SEQ ID NO: 3317 - DNA, 25 bp, Homo sapiens
aaatttccatcagccaacccaacag

SEQ ID NO: 3318 - DNA, 25 bp, Homo sapiens
aatttccatcagccaacccaacagc

SEQ ID NO: 3319 - DNA, 25 bp, Homo sapiens
atttccatcagccaacccaacagca

SEQ ID NO: 3320 - DNA, 25 bp, Homo sapiens
tttccatcagccaacccaacagcaa

SEQ ID NO: 3321 - DNA, 25 bp, Homo sapiens
ttccatcagccaacccaacagcaag

SEQ ID NO: 3322 - DNA, 25 bp, Homo sapiens
tccatcagccaacccaacagcaagt

SEQ ID NO: 3323 - DNA, 25 bp, Homo sapiens
ccatcagccaacccaacagcaagtc

SEQ ID NO: 3324 - DNA, 25 bp, Homo sapiens
catcagccaacccaacagcaagtcc

SEQ ID NO: 3325 - DNA, 25 bp, Homo sapiens
atcagccaacccaacagcaagtcca

SEQ ID NO: 3326 - DNA, 25 bp, Homo sapiens
tcagccaacccaacagcaagtccag

SEQ ID NO: 3327 - DNA, 25 bp, Homo sapiens
cagccaacccaacagcaagtccagc

SEQ ID NO: 3328 - DNA, 25 bp, Homo sapiens
agccaacccaacagcaagtccagca

SEQ ID NO: 3329 - DNA, 25 bp, Homo sapiens
gccaacccaacagcaagtccagcag

SEQ ID NO: 3330 - DNA, 25 bp, Homo sapiens
ccaacccaacagcaagtccagcagt

SEQ ID NO: 3331 - DNA, 25 bp, Homo sapiens
caacccaacagcaagtccagcagtg

SEQ ID NO: 3332 - DNA, 25 bp, Homo sapiens
aacccaacagcaagtccagcagtgg

SEQ ID NO: 3333 - DNA, 25 bp, Homo sapiens
acccaacagcaagtccagcagtggc

SEQ ID NO: 3334 - DNA, 25 bp, Homo sapiens
cccaacagcaagtccagcagtggca

SEQ ID NO: 3335 - DNA, 25 bp, Homo sapiens
ccaacagcaagtccagcagtggcac

SEQ ID NO: 3336 - DNA, 25 bp, Homo sapiens
caacagcaagtccagcagtggcacc

SEQ ID NO: 3337 - DNA, 25 bp, Homo sapiens
aacagcaagtccagcagtggcacca

SEQ ID NO: 3338 - DNA, 25 bp, Homo sapiens
acagcaagtccagcagtggcaccag

SEQ ID NO: 3339 - DNA, 25 bp, Homo sapiens
cagcaagtccagcagtggcaccaga

SEQ ID NO: 3340 - DNA, 25 bp, Homo sapiens
agcaagtccagcagtggcaccagat

SEQ ID NO: 3341 - DNA, 25 bp, Homo sapiens
gcaagtccagcagtggcaccagatc

SEQ ID NO: 3342 - DNA, 25 bp, Homo sapiens
caagtccagcagtggcaccagatct

SEQ ID NO: 3343 - DNA, 25 bp, Homo sapiens
aagtccagcagtggcaccagatctg

SEQ ID NO: 3344 - DNA, 25 bp, Homo sapiens
agtccagcagtggcaccagatctgg

SEQ ID NO: 3345 - DNA, 25 bp, Homo sapiens
gtccagcagtggcaccagatctgga

SEQ ID NO: 3346 - DNA, 25 bp, Homo sapiens
tccagcagtggcaccagatctggaa

SEQ ID NO: 3347 - DNA, 25 bp, Homo sapiens
ccagcagtggcaccagatctggaag

SEQ ID NO: 3348 - DNA, 25 bp, Homo sapiens
cagcagtggcaccagatctggaagc

SEQ ID NO: 3349 - DNA, 25 bp, Homo sapiens
agcagtggcaccagatctggaagcc

SEQ ID NO: 3350 - DNA, 25 bp, Homo sapiens
gcagtggcaccagatctggaagcca

SEQ ID NO: 3351 - DNA, 25 bp, Homo sapiens
cagtggcaccagatctggaagccag

SEQ ID NO: 3352 - DNA, 25 bp, Homo sapiens
agtggcaccagatctggaagccagc

SEQ ID NO: 3353 - DNA, 25 bp, Homo sapiens
gtggcaccagatctggaagccagca

SEQ ID NO: 3354 - DNA, 25 bp, Homo sapiens
tggcaccagatctggaagccagcag

SEQ ID NO: 3355 - DNA, 25 bp, Homo sapiens
ggcaccagatctggaagccagcaga

SEQ ID NO: 3356 - DNA, 25 bp, Homo sapiens
gcaccagatctggaagccagcagat

SEQ ID NO: 3357 - DNA, 25 bp, Homo sapiens
caccagatctggaagccagcagatc

SEQ ID NO: 3358 - DNA, 25 bp, Homo sapiens
accagatctggaagccagcagatct

SEQ ID NO: 3359 - DNA, 25 bp, Homo sapiens
ccagatctggaagccagcagatctc

SEQ ID NO: 3360 - DNA, 25 bp, Homo sapiens
cagatctggaagccagcagatctct

SEQ ID NO: 3361 - DNA, 25 bp, Homo sapiens
agatctggaagccagcagatctctc

SEQ ID NO: 3362 - DNA, 25 bp, Homo sapiens
gatctggaagccagcagatctctca

SEQ ID NO: 3363 - DNA, 25 bp, Homo sapiens
atctggaagccagcagatctctcag

SEQ ID NO: 3364 - DNA, 25 bp, Homo sapiens
tctggaagccagcagatctctcagg

SEQ ID NO: 3365 - DNA, 25 bp, Homo sapiens
ctggaagccagcagatctctcagga

SEQ ID NO: 3366 - DNA, 25 bp, Homo sapiens
tggaagccagcagatctctcaggac

SEQ ID NO: 3367 - DNA, 25 bp, Homo sapiens
ggaagccagcagatctctcaggacg

SEQ ID NO: 3368 - DNA, 25 bp, Homo sapiens
gaagccagcagatctctcaggacga

SEQ ID NO: 3369 - DNA, 25 bp, Homo sapiens
aagccagcagatctctcaggacgac

SEQ ID NO: 3370 - DNA, 25 bp, Homo sapiens
agccagcagatctctcaggacgacc

SEQ ID NO: 3371 - DNA, 25 bp, Homo sapiens
gccagcagatctctcaggacgacca

SEQ ID NO: 3372 - DNA, 25 bp, Homo sapiens
ccagcagatctctcaggacgaccag

SEQ ID NO: 3373 - DNA, 25 bp, Homo sapiens
cagcagatctctcaggacgaccagt

SEQ ID NO: 3374 - DNA, 25 bp, Homo sapiens
agcagatctctcaggacgaccagtc

SEQ ID NO: 3375 - DNA, 25 bp, Homo sapiens
gcagatctctcaggacgaccagtca

SEQ ID NO: 3376 - DNA, 25 bp, Homo sapiens
cagatctctcaggacgaccagtcaa

SEQ ID NO: 3377 - DNA, 25 bp, Homo sapiens
agatctctcaggacgaccagtcaag

SEQ ID NO: 3378 - DNA, 25 bp, Homo sapiens
gatctctcaggacgaccagtcaagc

SEQ ID NO: 3379 - DNA, 25 bp, Homo sapiens
atctctcaggacgaccagtcaagct

SEQ ID NO: 3380 - DNA, 25 bp, Homo sapiens
tctctcaggacgaccagtcaagctc

SEQ ID NO: 3381 - DNA, 25 bp, Homo sapiens
ctctcaggacgaccagtcaagctct

SEQ ID NO: 3382 - DNA, 25 bp, Homo sapiens
tctcaggacgaccagtcaagctctc

SEQ ID NO: 3383 - DNA, 25 bp, Homo sapiens
ctcaggacgaccagtcaagctctcc

SEQ ID NO: 3384 - DNA, 25 bp, Homo sapiens
tcaggacgaccagtcaagctctcct

SEQ ID NO: 3385 - DNA, 25 bp, Homo sapiens
caggacgaccagtcaagctctcctg

SEQ ID NO: 3386 - DNA, 25 bp, Homo sapiens
aggacgaccagtcaagctctcctgg

SEQ ID NO: 3387 - DNA, 25 bp, Homo sapiens
ggacgaccagtcaagctctcctggg

SEQ ID NO: 3388 - DNA, 25 bp, Homo sapiens
gacgaccagtcaagctctcctggga

SEQ ID NO: 3389 - DNA, 25 bp, Homo sapiens
acgaccagtcaagctctcctgggag

SEQ ID NO: 3390 - DNA, 25 bp, Homo sapiens
cgaccagtcaagctctcctgggagc

SEQ ID NO: 3391 - DNA, 25 bp, Homo sapiens
gaccagtcaagctctcctgggagct

SEQ ID NO: 3392 - DNA, 25 bp, Homo sapiens
accagtcaagctctcctgggagctc

SEQ ID NO: 3393 - DNA, 25 bp, Homo sapiens
ccagtcaagctctcctgggagctca

SEQ ID NO: 3394 - DNA, 25 bp, Homo sapiens
cagtcaagctctcctgggagctcag

SEQ ID NO: 3395 - DNA, 25 bp, Homo sapiens
agtcaagctctcctgggagctcaga

SEQ ID NO: 3396 - DNA, 25 bp, Homo sapiens
gtcaagctctcctgggagctcagac

SEQ ID NO: 3397 - DNA, 25 bp, Homo sapiens
tcaagctctcctgggagctcagaca

SEQ ID NO: 3398 - DNA, 25 bp, Homo sapiens
caagctctcctgggagctcagacat

SEQ ID NO: 3399 - DNA, 25 bp, Homo sapiens
aagctctcctgggagctcagacatt

SEQ ID NO: 3400 - DNA, 25 bp, Homo sapiens
agctctcctgggagctcagacattc

SEQ ID NO: 3401 - DNA, 25 bp, Homo sapiens
gctctcctgggagctcagacattct

SEQ ID NO: 3402 - DNA, 25 bp, Homo sapiens
ctctcctgggagctcagacattctg

SEQ ID NO: 3403 - DNA, 25 bp, Homo sapiens
tctcctgggagctcagacattctgg

SEQ ID NO: 3404 - DNA, 25 bp, Homo sapiens
ctcctgggagctcagacattctggg

SEQ ID NO: 3405 - DNA, 25 bp, Homo sapiens
tcctgggagctcagacattctgggc

SEQ ID NO: 3406 - DNA, 25 bp, Homo sapiens
cctgggagctcagacattctgggca

SEQ ID NO: 3407 - DNA, 25 bp, Homo sapiens
ctgggagctcagacattctgggcaa

SEQ ID NO: 3408 - DNA, 25 bp, Homo sapiens
tgggagctcagacattctgggcaag

SEQ ID NO: 3409 - DNA, 25 bp, Homo sapiens
gggagctcagacattctgggcaagg

SEQ ID NO: 3410 - DNA, 25 bp, Homo sapiens
ggagctcagacattctgggcaagga

SEQ ID NO: 3411 - DNA, 25 bp, Homo sapiens
gagctcagacattctgggcaaggag

SEQ ID NO: 3412 - DNA, 25 bp, Homo sapiens
agctcagacattctgggcaaggaga

SEQ ID NO: 3413 - DNA, 25 bp, Homo sapiens
gctcagacattctgggcaaggagag

SEQ ID NO: 3414 - DNA, 25 bp, Homo sapiens
ctcagacattctgggcaaggagagc

SEQ ID NO: 3415 - DNA, 25 bp, Homo sapiens
tcagacattctgggcaaggagagcg

SEQ ID NO: 3416 - DNA, 25 bp, Homo sapiens
cagacattctgggcaaggagagcga

SEQ ID NO: 3417 - DNA, 25 bp, Homo sapiens
agacattctgggcaaggagagcgag

SEQ ID NO: 3418 - DNA, 25 bp, Homo sapiens
gacattctgggcaaggagagcgagg

SEQ ID NO: 3419 - DNA, 25 bp, Homo sapiens
acattctgggcaaggagagcgaggg

SEQ ID NO: 3420 - DNA, 25 bp, Homo sapiens
cattctgggcaaggagagcgagggg

SEQ ID NO: 3421 - DNA, 25 bp, Homo sapiens
attctgggcaaggagagcgaggggt

SEQ ID NO: 3422 - DNA, 25 bp, Homo sapiens
ttctgggcaaggagagcgaggggtc

SEQ ID NO: 3423 - DNA, 25 bp, Homo sapiens
tctgggcaaggagagcgaggggtcc

SEQ ID NO: 3424 - DNA, 25 bp, Homo sapiens
ctgggcaaggagagcgaggggtccc

SEQ ID NO: 3425 - DNA, 25 bp, Homo sapiens
tgggcaaggagagcgaggggtcccg

SEQ ID NO: 3426 - DNA, 25 bp, Homo sapiens
gggcaaggagagcgaggggtcccgc

SEQ ID NO: 3427 - DNA, 25 bp, Homo sapiens
ggcaaggagagcgaggggtcccgca

SEQ ID NO: 3428 - DNA, 25 bp, Homo sapiens
gcaaggagagcgaggggtcccgcag

SEQ ID NO: 3429 - DNA, 25 bp, Homo sapiens
caaggagagcgaggggtcccgcagc

SEQ ID NO: 3430 - DNA, 25 bp, Homo sapiens
aaggagagcgaggggtcccgcagcc

SEQ ID NO: 3431 - DNA, 25 bp, Homo sapiens
aggagagcgaggggtcccgcagccc

SEQ ID NO: 3432 - DNA, 25 bp, Homo sapiens
ggagagcgaggggtcccgcagcccc

SEQ ID NO: 3433 - DNA, 25 bp, Homo sapiens
gagagcgaggggtcccgcagccccg

SEQ ID NO: 3434 - DNA, 25 bp, Homo sapiens
agagcgaggggtcccgcagccccga

SEQ ID NO: 3435 - DNA, 25 bp, Homo sapiens
gagcgaggggtcccgcagccccgac

SEQ ID NO: 3436 - DNA, 25 bp, Homo sapiens
agcgaggggtcccgcagccccgacc

SEQ ID NO: 3437 - DNA, 25 bp, Homo sapiens
gcgaggggtcccgcagccccgaccc

SEQ ID NO: 3438 - DNA, 25 bp, Homo sapiens
cgaggggtcccgcagccccgaccct

SEQ ID NO: 3439 - DNA, 25 bp, Homo sapiens
gaggggtcccgcagccccgaccctg

SEQ ID NO: 3440 - DNA, 25 bp, Homo sapiens
aggggtcccgcagccccgaccctga

SEQ ID NO: 3441 - DNA, 25 bp, Homo sapiens
ggggtcccgcagccccgaccctgag

SEQ ID NO: 3442 - DNA, 25 bp, Homo sapiens
gggtcccgcagccccgaccctgagc

SEQ ID NO: 3443 - DNA, 25 bp, Homo sapiens
ggtcccgcagccccgaccctgagca

SEQ ID NO: 3444 - DNA, 25 bp, Homo sapiens
gtcccgcagccccgaccctgagcag

SEQ ID NO: 3445 - DNA, 25 bp, Homo sapiens
tcccgcagccccgaccctgagcaga

SEQ ID NO: 3446 - DNA, 25 bp, Homo sapiens
cccgcagccccgaccctgagcagat

SEQ ID NO: 3447 - DNA, 25 bp, Homo sapiens
ccgcagccccgaccctgagcagatg

SEQ ID NO: 3448 - DNA, 25 bp, Homo sapiens
cgcagccccgaccctgagcagatga

SEQ ID NO: 3449 - DNA, 25 bp, Homo sapiens
gcagccccgaccctgagcagatgac

SEQ ID NO: 3450 - DNA, 25 bp, Homo sapiens
cagccccgaccctgagcagatgaca

SEQ ID NO: 3451 - DNA, 25 bp, Homo sapiens
agccccgaccctgagcagatgacaa

SEQ ID NO: 3452 - DNA, 25 bp, Homo sapiens
gccccgaccctgagcagatgacaag

SEQ ID NO: 3453 - DNA, 25 bp, Homo sapiens
ccccgaccctgagcagatgacaagc

SEQ ID NO: 3454 - DNA, 25 bp, Homo sapiens
cccgaccctgagcagatgacaagca

SEQ ID NO: 3455 - DNA, 25 bp, Homo sapiens
ccgaccctgagcagatgacaagcat

SEQ ID NO: 3456 - DNA, 25 bp, Homo sapiens
cgaccctgagcagatgacaagcatc

SEQ ID NO: 3457 - DNA, 25 bp, Homo sapiens
gaccctgagcagatgacaagcatca

SEQ ID NO: 3458 - DNA, 25 bp, Homo sapiens
accctgagcagatgacaagcatcaa

SEQ ID NO: 3459 - DNA, 25 bp, Homo sapiens
ccctgagcagatgacaagcatcaat

SEQ ID NO: 3460 - DNA, 25 bp, Homo sapiens
cctgagcagatgacaagcatcaatg

SEQ ID NO: 3461 - DNA, 25 bp, Homo sapiens
ctgagcagatgacaagcatcaatgg

SEQ ID NO: 3462 - DNA, 25 bp, Homo sapiens
tgagcagatgacaagcatcaatggt

SEQ ID NO: 3463 - DNA, 25 bp, Homo sapiens
gagcagatgacaagcatcaatggtg

SEQ ID NO: 3464 - DNA, 25 bp, Homo sapiens
agcagatgacaagcatcaatggtga

SEQ ID NO: 3465 - DNA, 25 bp, Homo sapiens
gcagatgacaagcatcaatggtgag

SEQ ID NO: 3466 - DNA, 25 bp, Homo sapiens
cagatgacaagcatcaatggtgaga

SEQ ID NO: 3467 - DNA, 25 bp, Homo sapiens
agatgacaagcatcaatggtgagaa

SEQ ID NO: 3468 - DNA, 25 bp, Homo sapiens
gatgacaagcatcaatggtgagaag

SEQ ID NO: 3469 - DNA, 25 bp, Homo sapiens
atgacaagcatcaatggtgagaagg

SEQ ID NO: 3470 - DNA, 25 bp, Homo sapiens
tgacaagcatcaatggtgagaaggc

SEQ ID NO: 3471 - DNA, 25 bp, Homo sapiens
gacaagcatcaatggtgagaaggcc

SEQ ID NO: 3472 - DNA, 25 bp, Homo sapiens
acaagcatcaatggtgagaaggccc

SEQ ID NO: 3473 - DNA, 25 bp, Homo sapiens
caagcatcaatggtgagaaggccca

SEQ ID NO: 3474 - DNA, 25 bp, Homo sapiens
aagcatcaatggtgagaaggcccag

SEQ ID NO: 3475 - DNA, 25 bp, Homo sapiens
agcatcaatggtgagaaggcccagg

SEQ ID NO: 3476 - DNA, 25 bp, Homo sapiens
gcatcaatggtgagaaggcccagga

SEQ ID NO: 3477 - DNA, 25 bp, Homo sapiens
catcaatggtgagaaggcccaggag

SEQ ID NO: 3478 - DNA, 25 bp, Homo sapiens
atcaatggtgagaaggcccaggagc

SEQ ID NO: 3479 - DNA, 25 bp, Homo sapiens
tcaatggtgagaaggcccaggagct

SEQ ID NO: 3480 - DNA, 25 bp, Homo sapiens
caatggtgagaaggcccaggagctg

SEQ ID NO: 3481 - DNA, 25 bp, Homo sapiens
aatggtgagaaggcccaggagctgg

SEQ ID NO: 3482 - DNA, 25 bp, Homo sapiens
atggtgagaaggcccaggagctggg

SEQ ID NO: 3483 - DNA, 25 bp, Homo sapiens
tggtgagaaggcccaggagctgggc

SEQ ID NO: 3484 - DNA, 25 bp, Homo sapiens
ggtgagaaggcccaggagctgggct

SEQ ID NO: 3485 - DNA, 25 bp, Homo sapiens
gtgagaaggcccaggagctgggctc

SEQ ID NO: 3486 - DNA, 25 bp, Homo sapiens
tgagaaggcccaggagctgggctcc

SEQ ID NO: 3487 - DNA, 25 bp, Homo sapiens
gagaaggcccaggagctgggctcca

SEQ ID NO: 3488 - DNA, 25 bp, Homo sapiens
agaaggcccaggagctgggctccag

SEQ ID NO: 3489 - DNA, 25 bp, Homo sapiens
gaaggcccaggagctgggctccagt

SEQ ID NO: 3490 - DNA, 25 bp, Homo sapiens
aaggcccaggagctgggctccagtg

SEQ ID NO: 3491 - DNA, 25 bp, Homo sapiens
aggcccaggagctgggctccagtgc

SEQ ID NO: 3492 - DNA, 25 bp, Homo sapiens
ggcccaggagctgggctccagtgcg

SEQ ID NO: 3493 - DNA, 25 bp, Homo sapiens
gcccaggagctgggctccagtgcga

SEQ ID NO: 3494 - DNA, 25 bp, Homo sapiens
cccaggagctgggctccagtgcgac

SEQ ID NO: 3495 - DNA, 25 bp, Homo sapiens
ccaggagctgggctccagtgcgaca

SEQ ID NO: 3496 - DNA, 25 bp, Homo sapiens
caggagctgggctccagtgcgacac

SEQ ID NO: 3497 - DNA, 25 bp, Homo sapiens
aggagctgggctccagtgcgacacc

SEQ ID NO: 3498 - DNA, 25 bp, Homo sapiens
ggagctgggctccagtgcgacacca

SEQ ID NO: 3499 - DNA, 25 bp, Homo sapiens
gagctgggctccagtgcgacaccaa

SEQ ID NO: 3500 - DNA, 25 bp, Homo sapiens
agctgggctccagtgcgacaccaac

SEQ ID NO: 3501 - DNA, 25 bp, Homo sapiens
gctgggctccagtgcgacaccaacc

SEQ ID NO: 3502 - DNA, 25 bp, Homo sapiens
ctgggctccagtgcgacaccaacca

SEQ ID NO: 3503 - DNA, 25 bp, Homo sapiens
tgggctccagtgcgacaccaaccaa

SEQ ID NO: 3504 - DNA, 25 bp, Homo sapiens
gggctccagtgcgacaccaaccaaa

SEQ ID NO: 3505 - DNA, 25 bp, Homo sapiens
ggctccagtgcgacaccaaccaaaa

SEQ ID NO: 3506 - DNA, 25 bp, Homo sapiens
gctccagtgcgacaccaaccaaaaa

SEQ ID NO: 3507 - DNA, 25 bp, Homo sapiens
ctccagtgcgacaccaaccaaaaag

SEQ ID NO: 3508 - DNA, 25 bp, Homo sapiens
tccagtgcgacaccaaccaaaaaga

SEQ ID NO: 3509 - DNA, 25 bp, Homo sapiens
ccagtgcgacaccaaccaaaaagac

SEQ ID NO: 3510 - DNA, 25 bp, Homo sapiens
cagtgcgacaccaaccaaaaagact

SEQ ID NO: 3511 - DNA, 25 bp, Homo sapiens
agtgcgacaccaaccaaaaagactg

SEQ ID NO: 3512 - DNA, 25 bp, Homo sapiens
gtgcgacaccaaccaaaaagactgt

SEQ ID NO: 3513 - DNA, 25 bp, Homo sapiens
tgcgacaccaaccaaaaagactgtc

SEQ ID NO: 3514 - DNA, 25 bp, Homo sapiens
gcgacaccaaccaaaaagactgtcc

SEQ ID NO: 3515 - DNA, 25 bp, Homo sapiens
cgacaccaaccaaaaagactgtccc

SEQ ID NO: 3516 - DNA, 25 bp, Homo sapiens
gacaccaaccaaaaagactgtcccc

SEQ ID NO: 3517 - DNA, 25 bp, Homo sapiens
acaccaaccaaaaagactgtcccct

SEQ ID NO: 3518 - DNA, 25 bp, Homo sapiens
caccaaccaaaaagactgtcccctt

SEQ ID NO: 3519 - DNA, 25 bp, Homo sapiens
accaaccaaaaagactgtccccttc

SEQ ID NO: 3520 - DNA, 25 bp, Homo sapiens
ccaaccaaaaagactgtccccttca

SEQ ID NO: 3521 - DNA, 25 bp, Homo sapiens
caaccaaaaagactgtccccttcaa

SEQ ID NO: 3522 - DNA, 25 bp, Homo sapiens
aaccaaaaagactgtccccttcaag

SEQ ID NO: 3523 - DNA, 25 bp, Homo sapiens
accaaaaagactgtccccttcaaga

SEQ ID NO: 3524 - DNA, 25 bp, Homo sapiens
ccaaaaagactgtccccttcaagag

SEQ ID NO: 3525 - DNA, 25 bp, Homo sapiens
caaaaagactgtccccttcaagagg

SEQ ID NO: 3526 - DNA, 25 bp, Homo sapiens
aaaaagactgtccccttcaagaggg

SEQ ID NO: 3527 - DNA, 25 bp, Homo sapiens
aaaagactgtccccttcaagagggg

SEQ ID NO: 3528 - DNA, 25 bp, Homo sapiens
aaagactgtccccttcaagaggggc

SEQ ID NO: 3529 - DNA, 25 bp, Homo sapiens
aagactgtccccttcaagaggggcg

SEQ ID NO: 3530 - DNA, 25 bp, Homo sapiens
agactgtccccttcaagaggggcgt

SEQ ID NO: 3531 - DNA, 25 bp, Homo sapiens
gactgtccccttcaagaggggcgtg

SEQ ID NO: 3532 - DNA, 25 bp, Homo sapiens
actgtccccttcaagaggggcgtga

SEQ ID NO: 3533 - DNA, 25 bp, Homo sapiens
ctgtccccttcaagaggggcgtgag

SEQ ID NO: 3534 - DNA, 25 bp, Homo sapiens
tgtccccttcaagaggggcgtgagg

SEQ ID NO: 3535 - DNA, 25 bp, Homo sapiens
gtccccttcaagaggggcgtgagga

SEQ ID NO: 3536 - DNA, 25 bp, Homo sapiens
tccccttcaagaggggcgtgaggag

SEQ ID NO: 3537 - DNA, 25 bp, Homo sapiens
ccccttcaagaggggcgtgaggagg

SEQ ID NO: 3538 - DNA, 25 bp, Homo sapiens
cccttcaagaggggcgtgaggaggg

SEQ ID NO: 3539 - DNA, 25 bp, Homo sapiens
ccttcaagaggggcgtgaggagggg

SEQ ID NO: 3540 - DNA, 25 bp, Homo sapiens
cttcaagaggggcgtgaggaggggt

SEQ ID NO: 3541 - DNA, 25 bp, Homo sapiens
ttcaagaggggcgtgaggaggggtg

SEQ ID NO: 3542 - DNA, 25 bp, Homo sapiens
tcaagaggggcgtgaggaggggtga

SEQ ID NO: 3543 - DNA, 25 bp, Homo sapiens
caagaggggcgtgaggaggggtgat

SEQ ID NO: 3544 - DNA, 25 bp, Homo sapiens
aagaggggcgtgaggaggggtgatg

SEQ ID NO: 3545 - DNA, 25 bp, Homo sapiens
agaggggcgtgaggaggggtgatgt

SEQ ID NO: 3546 - DNA, 25 bp, Homo sapiens
gaggggcgtgaggaggggtgatgtg

SEQ ID NO: 3547 - DNA, 25 bp, Homo sapiens
aggggcgtgaggaggggtgatgtgt

SEQ ID NO: 3548 - DNA, 25 bp, Homo sapiens
ggggcgtgaggaggggtgatgtgtt

SEQ ID NO: 3549 - DNA, 25 bp, Homo sapiens
gggcgtgaggaggggtgatgtgttg

SEQ ID NO: 3550 - DNA, 25 bp, Homo sapiens
ggcgtgaggaggggtgatgtgttgt

SEQ ID NO: 3551 - DNA, 25 bp, Homo sapiens
gcgtgaggaggggtgatgtgttgtt

SEQ ID NO: 3552 - DNA, 25 bp, Homo sapiens
cgtgaggaggggtgatgtgttgttg

SEQ ID NO: 3553 - DNA, 25 bp, Homo sapiens
gtgaggaggggtgatgtgttgttga

SEQ ID NO: 3554 - DNA, 25 bp, Homo sapiens
tgaggaggggtgatgtgttgttgat

SEQ ID NO: 3555 - DNA, 25 bp, Homo sapiens
gaggaggggtgatgtgttgttgatg

SEQ ID NO: 3556 - DNA, 25 bp, Homo sapiens
aggaggggtgatgtgttgttgatgg

SEQ ID NO: 3557 - DNA, 25 bp, Homo sapiens
ggaggggtgatgtgttgttgatggt

SEQ ID NO: 3558 - DNA, 25 bp, Homo sapiens
gaggggtgatgtgttgttgatggtg

SEQ ID NO: 3559 - DNA, 25 bp, Homo sapiens
aggggtgatgtgttgttgatggtgg

SEQ ID NO: 3560 - DNA, 25 bp, Homo sapiens
ggggtgatgtgttgttgatggtggc

SEQ ID NO: 3561 - DNA, 25 bp, Homo sapiens
gggtgatgtgttgttgatggtggcc

SEQ ID NO: 3562 - DNA, 25 bp, Homo sapiens
ggtgatgtgttgttgatggtggcca

SEQ ID NO: 3563 - DNA, 25 bp, Homo sapiens
gtgatgtgttgttgatggtggccaa

SEQ ID NO: 3564 - DNA, 25 bp, Homo sapiens
tgatgtgttgttgatggtggccaag

SEQ ID NO: 3565 - DNA, 25 bp, Homo sapiens
gatgtgttgttgatggtggccaagc

SEQ ID NO: 3566 - DNA, 25 bp, Homo sapiens
atgtgttgttgatggtggccaagct

SEQ ID NO: 3567 - DNA, 25 bp, Homo sapiens
tgtgttgttgatggtggccaagctg

SEQ ID NO: 3568 - DNA, 25 bp, Homo sapiens
gtgttgttgatggtggccaagctgg

SEQ ID NO: 3569 - DNA, 25 bp, Homo sapiens
tgttgttgatggtggccaagctgga

SEQ ID NO: 3570 - DNA, 25 bp, Homo sapiens
gttgttgatggtggccaagctggac

SEQ ID NO: 3571 - DNA, 25 bp, Homo sapiens
ttgttgatggtggccaagctggacc

SEQ ID NO: 3572 - DNA, 25 bp, Homo sapiens
tgttgatggtggccaagctggaccc

SEQ ID NO: 3573 - DNA, 25 bp, Homo sapiens
gttgatggtggccaagctggacccg

SEQ ID NO: 3574 - DNA, 25 bp, Homo sapiens
ttgatggtggccaagctggacccgg

SEQ ID NO: 3575 - DNA, 25 bp, Homo sapiens
tgatggtggccaagctggacccgga

SEQ ID NO: 3576 - DNA, 25 bp, Homo sapiens
gatggtggccaagctggacccggac

SEQ ID NO: 3577 - DNA, 25 bp, Homo sapiens
atggtggccaagctggacccggact

SEQ ID NO: 3578 - DNA, 25 bp, Homo sapiens
tggtggccaagctggacccggactc

SEQ ID NO: 3579 - DNA, 25 bp, Homo sapiens
ggtggccaagctggacccggactca

SEQ ID NO: 3580 - DNA, 25 bp, Homo sapiens
gtggccaagctggacccggactcag

SEQ ID NO: 3581 - DNA, 25 bp, Homo sapiens
tggccaagctggacccggactcagc

SEQ ID NO: 3582 - DNA, 25 bp, Homo sapiens
ggccaagctggacccggactcagcc

SEQ ID NO: 3583 - DNA, 25 bp, Homo sapiens
gccaagctggacccggactcagcca

SEQ ID NO: 3584 - DNA, 25 bp, Homo sapiens
ccaagctggacccggactcagccaa

SEQ ID NO: 3585 - DNA, 25 bp, Homo sapiens
caagctggacccggactcagccaag

SEQ ID NO: 3586 - DNA, 25 bp, Homo sapiens
aagctggacccggactcagccaagc

SEQ ID NO: 3587 - DNA, 25 bp, Homo sapiens
agctggacccggactcagccaagcc

SEQ ID NO: 3588 - DNA, 25 bp, Homo sapiens
gctggacccggactcagccaagcca

SEQ ID NO: 3589 - DNA, 25 bp, Homo sapiens
ctggacccggactcagccaagccag

SEQ ID NO: 3590 - DNA, 25 bp, Homo sapiens
tggacccggactcagccaagccaga

SEQ ID NO: 3591 - DNA, 25 bp, Homo sapiens
ggacccggactcagccaagccagag

SEQ ID NO: 3592 - DNA, 25 bp, Homo sapiens
gacccggactcagccaagccagaga

SEQ ID NO: 3593 - DNA, 25 bp, Homo sapiens
acccggactcagccaagccagagaa

SEQ ID NO: 3594 - DNA, 25 bp, Homo sapiens
cccggactcagccaagccagagaag

SEQ ID NO: 3595 - DNA, 25 bp, Homo sapiens
ccggactcagccaagccagagaaga

SEQ ID NO: 3596 - DNA, 25 bp, Homo sapiens
cggactcagccaagccagagaagac

SEQ ID NO: 3597 - DNA, 25 bp, Homo sapiens
ggactcagccaagccagagaagact

SEQ ID NO: 3598 - DNA, 25 bp, Homo sapiens
gactcagccaagccagagaagactc

SEQ ID NO: 3599 - DNA, 25 bp, Homo sapiens
actcagccaagccagagaagactca

SEQ ID NO: 3600 - DNA, 25 bp, Homo sapiens
ctcagccaagccagagaagactcat

SEQ ID NO: 3601 - DNA, 25 bp, Homo sapiens
tcagccaagccagagaagactcatc

SEQ ID NO: 3602 - DNA, 25 bp, Homo sapiens
cagccaagccagagaagactcatcc

SEQ ID NO: 3603 - DNA, 25 bp, Homo sapiens
agccaagccagagaagactcatccc

SEQ ID NO: 3604 - DNA, 25 bp, Homo sapiens
gccaagccagagaagactcatcccc

SEQ ID NO: 3605 - DNA, 25 bp, Homo sapiens
ccaagccagagaagactcatcccca

SEQ ID NO: 3606 - DNA, 25 bp, Homo sapiens
caagccagagaagactcatccccat

SEQ ID NO: 3607 - DNA, 25 bp, Homo sapiens
aagccagagaagactcatccccatg

SEQ ID NO: 3608 - DNA, 25 bp, Homo sapiens
agccagagaagactcatccccatga

SEQ ID NO: 3609 - DNA, 25 bp, Homo sapiens
gccagagaagactcatccccatgac

SEQ ID NO: 3610 - DNA, 25 bp, Homo sapiens
ccagagaagactcatccccatgacg

SEQ ID NO: 3611 - DNA, 25 bp, Homo sapiens
cagagaagactcatccccatgacgc

SEQ ID NO: 3612 - DNA, 25 bp, Homo sapiens
agagaagactcatccccatgacgcc

SEQ ID NO: 3613 - DNA, 25 bp, Homo sapiens
gagaagactcatccccatgacgccc

SEQ ID NO: 3614 - DNA, 25 bp, Homo sapiens
agaagactcatccccatgacgcccc

SEQ ID NO: 3615 - DNA, 25 bp, Homo sapiens
gaagactcatccccatgacgccccc

SEQ ID NO: 3616 - DNA, 25 bp, Homo sapiens
aagactcatccccatgacgcccccc

SEQ ID NO: 3617 - DNA, 25 bp, Homo sapiens
agactcatccccatgacgccccccc

SEQ ID NO: 3618 - DNA, 25 bp, Homo sapiens
gactcatccccatgacgccccccct

SEQ ID NO: 3619 - DNA, 25 bp, Homo sapiens
actcatccccatgacgccccccctt

SEQ ID NO: 3620 - DNA, 25 bp, Homo sapiens
ctcatccccatgacgcccccccttg

SEQ ID NO: 3621 - DNA, 25 bp, Homo sapiens
tcatccccatgacgcccccccttgc

SEQ ID NO: 3622 - DNA, 25 bp, Homo sapiens
catccccatgacgcccccccttgca

SEQ ID NO: 3623 - DNA, 25 bp, Homo sapiens
atccccatgacgcccccccttgcaa

SEQ ID NO: 3624 - DNA, 25 bp, Homo sapiens
tccccatgacgcccccccttgcaag

SEQ ID NO: 3625 - DNA, 25 bp, Homo sapiens
ccccatgacgcccccccttgcaaga

SEQ ID NO: 3626 - DNA, 25 bp, Homo sapiens
cccatgacgcccccccttgcaagac

SEQ ID NO: 3627 - DNA, 25 bp, Homo sapiens
ccatgacgcccccccttgcaagacc

SEQ ID NO: 3628 - DNA, 25 bp, Homo sapiens
catgacgcccccccttgcaagacct

SEQ ID NO: 3629 - DNA, 25 bp, Homo sapiens
atgacgcccccccttgcaagacctc

SEQ ID NO: 3630 - DNA, 25 bp, Homo sapiens
tgacgcccccccttgcaagacctct

SEQ ID NO: 3631 - DNA, 25 bp, Homo sapiens
gacgcccccccttgcaagacctctc

SEQ ID NO: 3632 - DNA, 25 bp, Homo sapiens
acgcccccccttgcaagacctctcc

SEQ ID NO: 3633 - DNA, 25 bp, Homo sapiens
cgcccccccttgcaagacctctccc

SEQ ID NO: 3634 - DNA, 25 bp, Homo sapiens
gcccccccttgcaagacctctcccc

SEQ ID NO: 3635 - DNA, 25 bp, Homo sapiens
cccccccttgcaagacctctccccc

SEQ ID NO: 3636 - DNA, 25 bp, Homo sapiens
ccccccttgcaagacctctcccccc

SEQ ID NO: 3637 - DNA, 25 bp, Homo sapiens
cccccttgcaagacctctccccccg

SEQ ID NO: 3638 - DNA, 25 bp, Homo sapiens
ccccttgcaagacctctccccccgc

SEQ ID NO: 3639 - DNA, 25 bp, Homo sapiens
cccttgcaagacctctccccccgcc

SEQ ID NO: 3640 - DNA, 25 bp, Homo sapiens
ccttgcaagacctctccccccgcca

SEQ ID NO: 3641 - DNA, 25 bp, Homo sapiens
cttgcaagacctctccccccgccac

SEQ ID NO: 3642 - DNA, 25 bp, Homo sapiens
ttgcaagacctctccccccgccaca

SEQ ID NO: 3643 - DNA, 25 bp, Homo sapiens
tgcaagacctctccccccgccacag

SEQ ID NO: 3644 - DNA, 25 bp, Homo sapiens
gcaagacctctccccccgccacaga

SEQ ID NO: 3645 - DNA, 25 bp, Homo sapiens
caagacctctccccccgccacagat

SEQ ID NO: 3646 - DNA, 25 bp, Homo sapiens
aagacctctccccccgccacagata

SEQ ID NO: 3647 - DNA, 25 bp, Homo sapiens
agacctctccccccgccacagatac

SEQ ID NO: 3648 - DNA, 25 bp, Homo sapiens
gacctctccccccgccacagatact

SEQ ID NO: 3649 - DNA, 25 bp, Homo sapiens
acctctccccccgccacagatactg

SEQ ID NO: 3650 - DNA, 25 bp, Homo sapiens
cctctccccccgccacagatactgg

SEQ ID NO: 3651 - DNA, 25 bp, Homo sapiens
ctctccccccgccacagatactgga

SEQ ID NO: 3652 - DNA, 25 bp, Homo sapiens
tctccccccgccacagatactggaa

SEQ ID NO: 3653 - DNA, 25 bp, Homo sapiens
ctccccccgccacagatactggaaa

SEQ ID NO: 3654 - DNA, 25 bp, Homo sapiens
tccccccgccacagatactggaaag

SEQ ID NO: 3655 - DNA, 25 bp, Homo sapiens
ccccccgccacagatactggaaagg

SEQ ID NO: 3656 - DNA, 25 bp, Homo sapiens
cccccgccacagatactggaaagga

SEQ ID NO: 3657 - DNA, 25 bp, Homo sapiens
ccccgccacagatactggaaaggaa

SEQ ID NO: 3658 - DNA, 25 bp, Homo sapiens
cccgccacagatactggaaaggaaa

SEQ ID NO: 3659 - DNA, 25 bp, Homo sapiens
ccgccacagatactggaaaggaaaa

SEQ ID NO: 3660 - DNA, 25 bp, Homo sapiens
cgccacagatactggaaaggaaaag

SEQ ID NO: 3661 - DNA, 25 bp, Homo sapiens
gccacagatactggaaaggaaaaga

SEQ ID NO: 3662 - DNA, 25 bp, Homo sapiens
ccacagatactggaaaggaaaagaa

SEQ ID NO: 3663 - DNA, 25 bp, Homo sapiens
cacagatactggaaaggaaaagaaa

SEQ ID NO: 3664 - DNA, 25 bp, Homo sapiens
acagatactggaaaggaaaagaaag

SEQ ID NO: 3665 - DNA, 25 bp, Homo sapiens
cagatactggaaaggaaaagaaagg

SEQ ID NO: 3666 - DNA, 25 bp, Homo sapiens
agatactggaaaggaaaagaaaggg

SEQ ID NO: 3667 - DNA, 25 bp, Homo sapiens
gatactggaaaggaaaagaaagggg

SEQ ID NO: 3668 - DNA, 25 bp, Homo sapiens
atactggaaaggaaaagaaagggga

SEQ ID NO: 3669 - DNA, 25 bp, Homo sapiens
tactggaaaggaaaagaaaggggag

SEQ ID NO: 3670 - DNA, 25 bp, Homo sapiens
actggaaaggaaaagaaaggggaga

SEQ ID NO: 3671 - DNA, 25 bp, Homo sapiens
ctggaaaggaaaagaaaggggagac

SEQ ID NO: 3672 - DNA, 25 bp, Homo sapiens
tggaaaggaaaagaaaggggagacc

SEQ ID NO: 3673 - DNA, 25 bp, Homo sapiens
ggaaaggaaaagaaaggggagacct

SEQ ID NO: 3674 - DNA, 25 bp, Homo sapiens
gaaaggaaaagaaaggggagacctc

SEQ ID NO: 3675 - DNA, 25 bp, Homo sapiens
aaaggaaaagaaaggggagacctct

SEQ ID NO: 3676 - DNA, 25 bp, Homo sapiens
aaggaaaagaaaggggagacctcta

SEQ ID NO: 3677 - DNA, 25 bp, Homo sapiens
aggaaaagaaaggggagacctctag

SEQ ID NO: 3678 - DNA, 25 bp, Homo sapiens
ggaaaagaaaggggagacctctagg

SEQ ID NO: 3679 - DNA, 25 bp, Homo sapiens
gaaaagaaaggggagacctctagga

SEQ ID NO: 3680 - DNA, 25 bp, Homo sapiens
aaaagaaaggggagacctctaggac

SEQ ID NO: 3681 - DNA, 25 bp, Homo sapiens
aaagaaaggggagacctctaggact

SEQ ID NO: 3682 - DNA, 25 bp, Homo sapiens
aagaaaggggagacctctaggactc

SEQ ID NO: 3683 - DNA, 25 bp, Homo sapiens
agaaaggggagacctctaggactcc

SEQ ID NO: 3684 - DNA, 25 bp, Homo sapiens
gaaaggggagacctctaggactcct

SEQ ID NO: 3685 - DNA, 25 bp, Homo sapiens
aaaggggagacctctaggactcctt

SEQ ID NO: 3686 - DNA, 25 bp, Homo sapiens
aaggggagacctctaggactccttg

SEQ ID NO: 3687 - DNA, 25 bp, Homo sapiens
aggggagacctctaggactccttgt

SEQ ID NO: 3688 - DNA, 25 bp, Homo sapiens
ggggagacctctaggactccttgtg

SEQ ID NO: 3689 - DNA, 25 bp, Homo sapiens
gggagacctctaggactccttgtgg

SEQ ID NO: 3690 - DNA, 25 bp, Homo sapiens
ggagacctctaggactccttgtggc

SEQ ID NO: 3691 - DNA, 25 bp, Homo sapiens
gagacctctaggactccttgtggct

SEQ ID NO: 3692 - DNA, 25 bp, Homo sapiens
agacctctaggactccttgtggctc

SEQ ID NO: 3693 - DNA, 25 bp, Homo sapiens
gacctctaggactccttgtggctcc

SEQ ID NO: 3694 - DNA, 25 bp, Homo sapiens
acctctaggactccttgtggctccc

SEQ ID NO: 3695 - DNA, 25 bp, Homo sapiens
cctctaggactccttgtggctccca

SEQ ID NO: 3696 - DNA, 25 bp, Homo sapiens
ctctaggactccttgtggctcccag

SEQ ID NO: 3697 - DNA, 25 bp, Homo sapiens
tctaggactccttgtggctcccagg

SEQ ID NO: 3698 - DNA, 25 bp, Homo sapiens
ctaggactccttgtggctcccaggc

SEQ ID NO: 3699 - DNA, 25 bp, Homo sapiens
taggactccttgtggctcccaggcc

SEQ ID NO: 3700 - DNA, 25 bp, Homo sapiens
aggactccttgtggctcccaggcca

SEQ ID NO: 3701 - DNA, 25 bp, Homo sapiens
ggactccttgtggctcccaggccag

SEQ ID NO: 3702 - DNA, 25 bp, Homo sapiens
gactccttgtggctcccaggccagc

SEQ ID NO: 3703 - DNA, 25 bp, Homo sapiens
actccttgtggctcccaggccagca

SEQ ID NO: 3704 - DNA, 25 bp, Homo sapiens
ctccttgtggctcccaggccagcac

SEQ ID NO: 3705 - DNA, 25 bp, Homo sapiens
tccttgtggctcccaggccagcacc

SEQ ID NO: 3706 - DNA, 25 bp, Homo sapiens
ccttgtggctcccaggccagcaccg

SEQ ID NO: 3707 - DNA, 25 bp, Homo sapiens
cttgtggctcccaggccagcaccga

SEQ ID NO: 3708 - DNA, 25 bp, Homo sapiens
ttgtggctcccaggccagcaccgag

SEQ ID NO: 3709 - DNA, 25 bp, Homo sapiens
tgtggctcccaggccagcaccgaga

SEQ ID NO: 3710 - DNA, 25 bp, Homo sapiens
gtggctcccaggccagcaccgagat

SEQ ID NO: 3711 - DNA, 25 bp, Homo sapiens
tggctcccaggccagcaccgagatc

SEQ ID NO: 3712 - DNA, 25 bp, Homo sapiens
ggctcccaggccagcaccgagatct

SEQ ID NO: 3713 - DNA, 25 bp, Homo sapiens
gctcccaggccagcaccgagatctt

SEQ ID NO: 3714 - DNA, 25 bp, Homo sapiens
ctcccaggccagcaccgagatcttg

SEQ ID NO: 3715 - DNA, 25 bp, Homo sapiens
tcccaggccagcaccgagatcttgg

SEQ ID NO: 3716 - DNA, 25 bp, Homo sapiens
cccaggccagcaccgagatcttggc

SEQ ID NO: 3717 - DNA, 25 bp, Homo sapiens
ccaggccagcaccgagatcttggcc

SEQ ID NO: 3718 - DNA, 25 bp, Homo sapiens
caggccagcaccgagatcttggccc

SEQ ID NO: 3719 - DNA, 25 bp, Homo sapiens
aggccagcaccgagatcttggcccc

SEQ ID NO: 3720 - DNA, 25 bp, Homo sapiens
ggccagcaccgagatcttggccccg

SEQ ID NO: 3721 - DNA, 25 bp, Homo sapiens
gccagcaccgagatcttggccccga

SEQ ID NO: 3722 - DNA, 25 bp, Homo sapiens
ccagcaccgagatcttggccccgaa

SEQ ID NO: 3723 - DNA, 25 bp, Homo sapiens
cagcaccgagatcttggccccgaaa

SEQ ID NO: 3724 - DNA, 25 bp, Homo sapiens
agcaccgagatcttggccccgaaag

SEQ ID NO: 3725 - DNA, 25 bp, Homo sapiens
gcaccgagatcttggccccgaaagc

SEQ ID NO: 3726 - DNA, 25 bp, Homo sapiens
caccgagatcttggccccgaaagct

SEQ ID NO: 3727 - DNA, 25 bp, Homo sapiens
accgagatcttggccccgaaagctg

SEQ ID NO: 3728 - DNA, 25 bp, Homo sapiens
ccgagatcttggccccgaaagctga

SEQ ID NO: 3729 - DNA, 25 bp, Homo sapiens
cgagatcttggccccgaaagctgag

SEQ ID NO: 3730 - DNA, 25 bp, Homo sapiens
gagatcttggccccgaaagctgaga

SEQ ID NO: 3731 - DNA, 25 bp, Homo sapiens
agatcttggccccgaaagctgagaa

SEQ ID NO: 3732 - DNA, 25 bp, Homo sapiens
gatcttggccccgaaagctgagaag

SEQ ID NO: 3733 - DNA, 25 bp, Homo sapiens
atcttggccccgaaagctgagaaga

SEQ ID NO: 3734 - DNA, 25 bp, Homo sapiens
tcttggccccgaaagctgagaagac

SEQ ID NO: 3735 - DNA, 25 bp, Homo sapiens
cttggccccgaaagctgagaagacc

SEQ ID NO: 3736 - DNA, 25 bp, Homo sapiens
ttggccccgaaagctgagaagaccc

SEQ ID NO: 3737 - DNA, 25 bp, Homo sapiens
tggccccgaaagctgagaagacccg

SEQ ID NO: 3738 - DNA, 25 bp, Homo sapiens
ggccccgaaagctgagaagacccgg

SEQ ID NO: 3739 - DNA, 25 bp, Homo sapiens
gccccgaaagctgagaagacccgga

SEQ ID NO: 3740 - DNA, 25 bp, Homo sapiens
ccccgaaagctgagaagacccggac

SEQ ID NO: 3741 - DNA, 25 bp, Homo sapiens
cccgaaagctgagaagacccggact

SEQ ID NO: 3742 - DNA, 25 bp, Homo sapiens
ccgaaagctgagaagacccggactg

SEQ ID NO: 3743 - DNA, 25 bp, Homo sapiens
cgaaagctgagaagacccggactgg

SEQ ID NO: 3744 - DNA, 25 bp, Homo sapiens
gaaagctgagaagacccggactggg

SEQ ID NO: 3745 - DNA, 25 bp, Homo sapiens
aaagctgagaagacccggactgggg

SEQ ID NO: 3746 - DNA, 25 bp, Homo sapiens
aagctgagaagacccggactggggg

SEQ ID NO: 3747 - DNA, 25 bp, Homo sapiens
agctgagaagacccggactgggggt

SEQ ID NO: 3748 - DNA, 25 bp, Homo sapiens
gctgagaagacccggactgggggtc

SEQ ID NO: 3749 - DNA, 25 bp, Homo sapiens
ctgagaagacccggactgggggtct

SEQ ID NO: 3750 - DNA, 25 bp, Homo sapiens
tgagaagacccggactgggggtctt

SEQ ID NO: 3751 - DNA, 25 bp, Homo sapiens
gagaagacccggactgggggtcttg

SEQ ID NO: 3752 - DNA, 25 bp, Homo sapiens
agaagacccggactgggggtcttgg

SEQ ID NO: 3753 - DNA, 25 bp, Homo sapiens
gaagacccggactgggggtcttggg

SEQ ID NO: 3754 - DNA, 25 bp, Homo sapiens
aagacccggactgggggtcttgggg

SEQ ID NO: 3755 - DNA, 25 bp, Homo sapiens
agacccggactgggggtcttgggga

SEQ ID NO: 3756 - DNA, 25 bp, Homo sapiens
gacccggactgggggtcttggggac

SEQ ID NO: 3757 - DNA, 25 bp, Homo sapiens
acccggactgggggtcttggggacc

SEQ ID NO: 3758 - DNA, 25 bp, Homo sapiens
cccggactgggggtcttggggaccc

SEQ ID NO: 3759 - DNA, 25 bp, Homo sapiens
ccggactgggggtcttggggaccca

SEQ ID NO: 3760 - DNA, 25 bp, Homo sapiens
cggactgggggtcttggggacccag

SEQ ID NO: 3761 - DNA, 25 bp, Homo sapiens
ggactgggggtcttggggacccagg

SEQ ID NO: 3762 - DNA, 25 bp, Homo sapiens
gactgggggtcttggggacccaggc

SEQ ID NO: 3763 - DNA, 25 bp, Homo sapiens
actgggggtcttggggacccaggcc

SEQ ID NO: 3764 - DNA, 25 bp, Homo sapiens
ctgggggtcttggggacccaggcca

SEQ ID NO: 3765 - DNA, 25 bp, Homo sapiens
tgggggtcttggggacccaggccaa

SEQ ID NO: 3766 - DNA, 25 bp, Homo sapiens
gggggtcttggggacccaggccaag

SEQ ID NO: 3767 - DNA, 25 bp, Homo sapiens
ggggtcttggggacccaggccaagg

SEQ ID NO: 3768 - DNA, 25 bp, Homo sapiens
gggtcttggggacccaggccaagga

SEQ ID NO: 3769 - DNA, 25 bp, Homo sapiens
ggtcttggggacccaggccaaggaa

SEQ ID NO: 3770 - DNA, 25 bp, Homo sapiens
gtcttggggacccaggccaaggaac

SEQ ID NO: 3771 - DNA, 25 bp, Homo sapiens
tcttggggacccaggccaaggaact

SEQ ID NO: 3772 - DNA, 25 bp, Homo sapiens
cttggggacccaggccaaggaactg

SEQ ID NO: 3773 - DNA, 25 bp, Homo sapiens
ttggggacccaggccaaggaactgt

SEQ ID NO: 3774 - DNA, 25 bp, Homo sapiens
tggggacccaggccaaggaactgtg

SEQ ID NO: 3775 - DNA, 25 bp, Homo sapiens
ggggacccaggccaaggaactgtgg

SEQ ID NO: 3776 - DNA, 25 bp, Homo sapiens
gggacccaggccaaggaactgtggc

SEQ ID NO: 3777 - DNA, 25 bp, Homo sapiens
ggacccaggccaaggaactgtggca

SEQ ID NO: 3778 - DNA, 25 bp, Homo sapiens
gacccaggccaaggaactgtggcac

SEQ ID NO: 3779 - DNA, 25 bp, Homo sapiens
acccaggccaaggaactgtggcact

SEQ ID NO: 3780 - DNA, 25 bp, Homo sapiens
cccaggccaaggaactgtggcactg

SEQ ID NO: 3781 - DNA, 25 bp, Homo sapiens
ccaggccaaggaactgtggcactga

SEQ ID NO: 3782 - DNA, 25 bp, Homo sapiens
caggccaaggaactgtggcactgaa

SEQ ID NO: 3783 - DNA, 25 bp, Homo sapiens
aggccaaggaactgtggcactgaaa

SEQ ID NO: 3784 - DNA, 25 bp, Homo sapiens
ggccaaggaactgtggcactgaaaa

SEQ ID NO: 3785 - DNA, 25 bp, Homo sapiens
gccaaggaactgtggcactgaaaaa

SEQ ID NO: 3786 - DNA, 25 bp, Homo sapiens
ccaaggaactgtggcactgaaaaaa

SEQ ID NO: 3787 - DNA, 25 bp, Homo sapiens
caaggaactgtggcactgaaaaaag

SEQ ID NO: 3788 - DNA, 25 bp, Homo sapiens
aaggaactgtggcactgaaaaaagg

SEQ ID NO: 3789 - DNA, 25 bp, Homo sapiens
aggaactgtggcactgaaaaaaggc

SEQ ID NO: 3790 - DNA, 25 bp, Homo sapiens
ggaactgtggcactgaaaaaaggcg

SEQ ID NO: 3791 - DNA, 25 bp, Homo sapiens
gaactgtggcactgaaaaaaggcga

SEQ ID NO: 3792 - DNA, 25 bp, Homo sapiens
aactgtggcactgaaaaaaggcgag

SEQ ID NO: 3793 - DNA, 25 bp, Homo sapiens
actgtggcactgaaaaaaggcgagg

SEQ ID NO: 3794 - DNA, 25 bp, Homo sapiens
ctgtggcactgaaaaaaggcgagga

SEQ ID NO: 3795 - DNA, 25 bp, Homo sapiens
tgtggcactgaaaaaaggcgaggag

SEQ ID NO: 3796 - DNA, 25 bp, Homo sapiens
gtggcactgaaaaaaggcgaggagg

SEQ ID NO: 3797 - DNA, 25 bp, Homo sapiens
tggcactgaaaaaaggcgaggaggg

SEQ ID NO: 3798 - DNA, 25 bp, Homo sapiens
ggcactgaaaaaaggcgaggagggt

SEQ ID NO: 3799 - DNA, 25 bp, Homo sapiens
gcactgaaaaaaggcgaggagggtc

SEQ ID NO: 3800 - DNA, 25 bp, Homo sapiens
cactgaaaaaaggcgaggagggtca

SEQ ID NO: 3801 - DNA, 25 bp, Homo sapiens
actgaaaaaaggcgaggagggtcaa

SEQ ID NO: 3802 - DNA, 25 bp, Homo sapiens
ctgaaaaaaggcgaggagggtcaaa

SEQ ID NO: 3803 - DNA, 25 bp, Homo sapiens
tgaaaaaaggcgaggagggtcaaag

SEQ ID NO: 3804 - DNA, 25 bp, Homo sapiens
gaaaaaaggcgaggagggtcaaagc

SEQ ID NO: 3805 - DNA, 25 bp, Homo sapiens
aaaaaaggcgaggagggtcaaagca

SEQ ID NO: 3806 - DNA, 25 bp, Homo sapiens
aaaaaggcgaggagggtcaaagcat

SEQ ID NO: 3807 - DNA, 25 bp, Homo sapiens
aaaaggcgaggagggtcaaagcata

SEQ ID NO: 3808 - DNA, 25 bp, Homo sapiens
aaaggcgaggagggtcaaagcatag

SEQ ID NO: 3809 - DNA, 25 bp, Homo sapiens
aaggcgaggagggtcaaagcatagt

SEQ ID NO: 3810 - DNA, 25 bp, Homo sapiens
aggcgaggagggtcaaagcatagtg

SEQ ID NO: 3811 - DNA, 25 bp, Homo sapiens
ggcgaggagggtcaaagcatagtgg

SEQ ID NO: 3812 - DNA, 25 bp, Homo sapiens
gcgaggagggtcaaagcatagtggg

SEQ ID NO: 3813 - DNA, 25 bp, Homo sapiens
cgaggagggtcaaagcatagtgggg

SEQ ID NO: 3814 - DNA, 25 bp, Homo sapiens
gaggagggtcaaagcatagtgggga

SEQ ID NO: 3815 - DNA, 25 bp, Homo sapiens
aggagggtcaaagcatagtggggaa

SEQ ID NO: 3816 - DNA, 25 bp, Homo sapiens
ggagggtcaaagcatagtggggaag

SEQ ID NO: 3817 - DNA, 25 bp, Homo sapiens
gagggtcaaagcatagtggggaagg

SEQ ID NO: 3818 - DNA, 25 bp, Homo sapiens
agggtcaaagcatagtggggaaggg

SEQ ID NO: 3819 - DNA, 25 bp, Homo sapiens
gggtcaaagcatagtggggaagggg

SEQ ID NO: 3820 - DNA, 25 bp, Homo sapiens
ggtcaaagcatagtggggaaggggc

SEQ ID NO: 3821 - DNA, 25 bp, Homo sapiens
gtcaaagcatagtggggaaggggct

SEQ ID NO: 3822 - DNA, 25 bp, Homo sapiens
tcaaagcatagtggggaaggggctt

SEQ ID NO: 3823 - DNA, 25 bp, Homo sapiens
caaagcatagtggggaaggggcttg

SEQ ID NO: 3824 - DNA, 25 bp, Homo sapiens
aaagcatagtggggaaggggcttgg

SEQ ID NO: 3825 - DNA, 25 bp, Homo sapiens
aagcatagtggggaaggggcttggg

SEQ ID NO: 3826 - DNA, 25 bp, Homo sapiens
agcatagtggggaaggggcttggga

SEQ ID NO: 3827 - DNA, 25 bp, Homo sapiens
gcatagtggggaaggggcttgggac

SEQ ID NO: 3828 - DNA, 25 bp, Homo sapiens
catagtggggaaggggcttgggacc

SEQ ID NO: 3829 - DNA, 25 bp, Homo sapiens
atagtggggaaggggcttgggaccc

SEQ ID NO: 3830 - DNA, 25 bp, Homo sapiens
tagtggggaaggggcttgggacccc

SEQ ID NO: 3831 - DNA, 25 bp, Homo sapiens
agtggggaaggggcttgggaccccc

SEQ ID NO: 3832 - DNA, 25 bp, Homo sapiens
gtggggaaggggcttgggaccccca

SEQ ID NO: 3833 - DNA, 25 bp, Homo sapiens
tggggaaggggcttgggacccccaa

SEQ ID NO: 3834 - DNA, 25 bp, Homo sapiens
ggggaaggggcttgggacccccaag

SEQ ID NO: 3835 - DNA, 25 bp, Homo sapiens
gggaaggggcttgggacccccaaga

SEQ ID NO: 3836 - DNA, 25 bp, Homo sapiens
ggaaggggcttgggacccccaagac

SEQ ID NO: 3837 - DNA, 25 bp, Homo sapiens
gaaggggcttgggacccccaagacc

SEQ ID NO: 3838 - DNA, 25 bp, Homo sapiens
aaggggcttgggacccccaagacca

SEQ ID NO: 3839 - DNA, 25 bp, Homo sapiens
aggggcttgggacccccaagaccac

SEQ ID NO: 3840 - DNA, 25 bp, Homo sapiens
ggggcttgggacccccaagaccaca

SEQ ID NO: 3841 - DNA, 25 bp, Homo sapiens
gggcttgggacccccaagaccacag

SEQ ID NO: 3842 - DNA, 25 bp, Homo sapiens
ggcttgggacccccaagaccacaga

SEQ ID NO: 3843 - DNA, 25 bp, Homo sapiens
gcttgggacccccaagaccacagag

SEQ ID NO: 3844 - DNA, 25 bp, Homo sapiens
cttgggacccccaagaccacagagc

SEQ ID NO: 3845 - DNA, 25 bp, Homo sapiens
ttgggacccccaagaccacagagct

SEQ ID NO: 3846 - DNA, 25 bp, Homo sapiens
tgggacccccaagaccacagagctg

SEQ ID NO: 3847 - DNA, 25 bp, Homo sapiens
gggacccccaagaccacagagctga

SEQ ID NO: 3848 - DNA, 25 bp, Homo sapiens
ggacccccaagaccacagagctgaa

SEQ ID NO: 3849 - DNA, 25 bp, Homo sapiens
gacccccaagaccacagagctgaaa

SEQ ID NO: 3850 - DNA, 25 bp, Homo sapiens
acccccaagaccacagagctgaaag

SEQ ID NO: 3851 - DNA, 25 bp, Homo sapiens
cccccaagaccacagagctgaaaga

SEQ ID NO: 3852 - DNA, 25 bp, Homo sapiens
ccccaagaccacagagctgaaagag

SEQ ID NO: 3853 - DNA, 25 bp, Homo sapiens
cccaagaccacagagctgaaagagg

SEQ ID NO: 3854 - DNA, 25 bp, Homo sapiens
ccaagaccacagagctgaaagaggc

SEQ ID NO: 3855 - DNA, 25 bp, Homo sapiens
caagaccacagagctgaaagaggct

SEQ ID NO: 3856 - DNA, 25 bp, Homo sapiens
aagaccacagagctgaaagaggctg

SEQ ID NO: 3857 - DNA, 25 bp, Homo sapiens
agaccacagagctgaaagaggctga

SEQ ID NO: 3858 - DNA, 25 bp, Homo sapiens
gaccacagagctgaaagaggctgag

SEQ ID NO: 3859 - DNA, 25 bp, Homo sapiens
accacagagctgaaagaggctgagc

SEQ ID NO: 3860 - DNA, 25 bp, Homo sapiens
ccacagagctgaaagaggctgagcc

SEQ ID NO: 3861 - DNA, 25 bp, Homo sapiens
cacagagctgaaagaggctgagccc

SEQ ID NO: 3862 - DNA, 25 bp, Homo sapiens
acagagctgaaagaggctgagcccc

SEQ ID NO: 3863 - DNA, 25 bp, Homo sapiens
cagagctgaaagaggctgagcccca

SEQ ID NO: 3864 - DNA, 25 bp, Homo sapiens
agagctgaaagaggctgagccccag

SEQ ID NO: 3865 - DNA, 25 bp, Homo sapiens
gagctgaaagaggctgagccccagg

SEQ ID NO: 3866 - DNA, 25 bp, Homo sapiens
agctgaaagaggctgagccccaggg

SEQ ID NO: 3867 - DNA, 25 bp, Homo sapiens
gctgaaagaggctgagccccagggc

SEQ ID NO: 3868 - DNA, 25 bp, Homo sapiens
ctgaaagaggctgagccccagggca

SEQ ID NO: 3869 - DNA, 25 bp, Homo sapiens
tgaaagaggctgagccccagggcaa

SEQ ID NO: 3870 - DNA, 25 bp, Homo sapiens
gaaagaggctgagccccagggcaaa

SEQ ID NO: 3871 - DNA, 25 bp, Homo sapiens
aaagaggctgagccccagggcaaag

SEQ ID NO: 3872 - DNA, 25 bp, Homo sapiens
aagaggctgagccccagggcaaaga

SEQ ID NO: 3873 - DNA, 25 bp, Homo sapiens
agaggctgagccccagggcaaagac

SEQ ID NO: 3874 - DNA, 25 bp, Homo sapiens
gaggctgagccccagggcaaagaca

SEQ ID NO: 3875 - DNA, 25 bp, Homo sapiens
aggctgagccccagggcaaagacag

SEQ ID NO: 3876 - DNA, 25 bp, Homo sapiens
ggctgagccccagggcaaagacagg

SEQ ID NO: 3877 - DNA, 25 bp, Homo sapiens
gctgagccccagggcaaagacaggc

SEQ ID NO: 3878 - DNA, 25 bp, Homo sapiens
ctgagccccagggcaaagacaggca

SEQ ID NO: 3879 - DNA, 25 bp, Homo sapiens
tgagccccagggcaaagacaggcag

SEQ ID NO: 3880 - DNA, 25 bp, Homo sapiens
gagccccagggcaaagacaggcagg

SEQ ID NO: 3881 - DNA, 25 bp, Homo sapiens
agccccagggcaaagacaggcaggg

SEQ ID NO: 3882 - DNA, 25 bp, Homo sapiens
gccccagggcaaagacaggcagggg

SEQ ID NO: 3883 - DNA, 25 bp, Homo sapiens
ccccagggcaaagacaggcagggga

SEQ ID NO: 3884 - DNA, 25 bp, Homo sapiens
cccagggcaaagacaggcaggggac

SEQ ID NO: 3885 - DNA, 25 bp, Homo sapiens
ccagggcaaagacaggcaggggacc

SEQ ID NO: 3886 - DNA, 25 bp, Homo sapiens
cagggcaaagacaggcaggggacca

SEQ ID NO: 3887 - DNA, 25 bp, Homo sapiens
agggcaaagacaggcaggggaccag

SEQ ID NO: 3888 - DNA, 25 bp, Homo sapiens
gggcaaagacaggcaggggaccagg

SEQ ID NO: 3889 - DNA, 25 bp, Homo sapiens
ggcaaagacaggcaggggaccaggc

SEQ ID NO: 3890 - DNA, 25 bp, Homo sapiens
gcaaagacaggcaggggaccaggcc

SEQ ID NO: 3891 - DNA, 25 bp, Homo sapiens
caaagacaggcaggggaccaggccc

SEQ ID NO: 3892 - DNA, 25 bp, Homo sapiens
aaagacaggcaggggaccaggcccc

SEQ ID NO: 3893 - DNA, 25 bp, Homo sapiens
aagacaggcaggggaccaggcccca

SEQ ID NO: 3894 - DNA, 25 bp, Homo sapiens
agacaggcaggggaccaggccccaa

SEQ ID NO: 3895 - DNA, 25 bp, Homo sapiens
gacaggcaggggaccaggccccaag

SEQ ID NO: 3896 - DNA, 25 bp, Homo sapiens
acaggcaggggaccaggccccaagc

SEQ ID NO: 3897 - DNA, 25 bp, Homo sapiens
caggcaggggaccaggccccaagcc

SEQ ID NO: 3898 - DNA, 25 bp, Homo sapiens
aggcaggggaccaggccccaagccc

SEQ ID NO: 3899 - DNA, 25 bp, Homo sapiens
ggcaggggaccaggccccaagccca

SEQ ID NO: 3900 - DNA, 25 bp, Homo sapiens
gcaggggaccaggccccaagcccaa

SEQ ID NO: 3901 - DNA, 25 bp, Homo sapiens
caggggaccaggccccaagcccaag

SEQ ID NO: 3902 - DNA, 25 bp, Homo sapiens
aggggaccaggccccaagcccaagg

SEQ ID NO: 3903 - DNA, 25 bp, Homo sapiens
ggggaccaggccccaagcccaaggg

SEQ ID NO: 3904 - DNA, 25 bp, Homo sapiens
gggaccaggccccaagcccaagggc

SEQ ID NO: 3905 - DNA, 25 bp, Homo sapiens
ggaccaggccccaagcccaagggcc

SEQ ID NO: 3906 - DNA, 25 bp, Homo sapiens
gaccaggccccaagcccaagggccc

SEQ ID NO: 3907 - DNA, 25 bp, Homo sapiens
accaggccccaagcccaagggcccg

SEQ ID NO: 3908 - DNA, 25 bp, Homo sapiens
ccaggccccaagcccaagggcccgg

SEQ ID NO: 3909 - DNA, 25 bp, Homo sapiens
caggccccaagcccaagggcccggc

SEQ ID NO: 3910 - DNA, 25 bp, Homo sapiens
aggccccaagcccaagggcccggcg

SEQ ID NO: 3911 - DNA, 25 bp, Homo sapiens
ggccccaagcccaagggcccggcga

SEQ ID NO: 3912 - DNA, 25 bp, Homo sapiens
gccccaagcccaagggcccggcgag

SEQ ID NO: 3913 - DNA, 25 bp, Homo sapiens
ccccaagcccaagggcccggcgagg

SEQ ID NO: 3914 - DNA, 25 bp, Homo sapiens
cccaagcccaagggcccggcgaggg

SEQ ID NO: 3915 - DNA, 25 bp, Homo sapiens
ccaagcccaagggcccggcgagggg

SEQ ID NO: 3916 - DNA, 25 bp, Homo sapiens
caagcccaagggcccggcgaggggg

SEQ ID NO: 3917 - DNA, 25 bp, Homo sapiens
aagcccaagggcccggcgagggggt

SEQ ID NO: 3918 - DNA, 25 bp, Homo sapiens
agcccaagggcccggcgagggggtg

SEQ ID NO: 3919 - DNA, 25 bp, Homo sapiens
gcccaagggcccggcgagggggtgc

SEQ ID NO: 3920 - DNA, 25 bp, Homo sapiens
cccaagggcccggcgagggggtgcg

SEQ ID NO: 3921 - DNA, 25 bp, Homo sapiens
ccaagggcccggcgagggggtgcga

SEQ ID NO: 3922 - DNA, 25 bp, Homo sapiens
caagggcccggcgagggggtgcgac

SEQ ID NO: 3923 - DNA, 25 bp, Homo sapiens
aagggcccggcgagggggtgcgacc

SEQ ID NO: 3924 - DNA, 25 bp, Homo sapiens
agggcccggcgagggggtgcgacca

SEQ ID NO: 3925 - DNA, 25 bp, Homo sapiens
gggcccggcgagggggtgcgaccag

SEQ ID NO: 3926 - DNA, 25 bp, Homo sapiens
ggcccggcgagggggtgcgaccagg

SEQ ID NO: 3927 - DNA, 25 bp, Homo sapiens
gcccggcgagggggtgcgaccaggg

SEQ ID NO: 3928 - DNA, 25 bp, Homo sapiens
cccggcgagggggtgcgaccaggga

SEQ ID NO: 3929 - DNA, 25 bp, Homo sapiens
ccggcgagggggtgcgaccagggaa

SEQ ID NO: 3930 - DNA, 25 bp, Homo sapiens
cggcgagggggtgcgaccagggaaa

SEQ ID NO: 3931 - DNA, 25 bp, Homo sapiens
ggcgagggggtgcgaccagggaaag

SEQ ID NO: 3932 - DNA, 25 bp, Homo sapiens
gcgagggggtgcgaccagggaaagc

SEQ ID NO: 3933 - DNA, 25 bp, Homo sapiens
cgagggggtgcgaccagggaaagca

SEQ ID NO: 3934 - DNA, 25 bp, Homo sapiens
gagggggtgcgaccagggaaagcag

SEQ ID NO: 3935 - DNA, 25 bp, Homo sapiens
agggggtgcgaccagggaaagcaga

SEQ ID NO: 3936 - DNA, 25 bp, Homo sapiens
gggggtgcgaccagggaaagcagag

SEQ ID NO: 3937 - DNA, 25 bp, Homo sapiens
ggggtgcgaccagggaaagcagaga

SEQ ID NO: 3938 - DNA, 25 bp, Homo sapiens
gggtgcgaccagggaaagcagagaa

SEQ ID NO: 3939 - DNA, 25 bp, Homo sapiens
ggtgcgaccagggaaagcagagaag

SEQ ID NO: 3940 - DNA, 25 bp, Homo sapiens
gtgcgaccagggaaagcagagaagg

SEQ ID NO: 3941 - DNA, 25 bp, Homo sapiens
tgcgaccagggaaagcagagaagga

SEQ ID NO: 3942 - DNA, 25 bp, Homo sapiens
gcgaccagggaaagcagagaaggag

SEQ ID NO: 3943 - DNA, 25 bp, Homo sapiens
cgaccagggaaagcagagaaggagg

SEQ ID NO: 3944 - DNA, 25 bp, Homo sapiens
gaccagggaaagcagagaaggaggg

SEQ ID NO: 3945 - DNA, 25 bp, Homo sapiens
accagggaaagcagagaaggaggga

SEQ ID NO: 3946 - DNA, 25 bp, Homo sapiens
ccagggaaagcagagaaggagggag

SEQ ID NO: 3947 - DNA, 25 bp, Homo sapiens
cagggaaagcagagaaggagggagc

SEQ ID NO: 3948 - DNA, 25 bp, Homo sapiens
agggaaagcagagaaggagggagca

SEQ ID NO: 3949 - DNA, 25 bp, Homo sapiens
gggaaagcagagaaggagggagcag

SEQ ID NO: 3950 - DNA, 25 bp, Homo sapiens
ggaaagcagagaaggagggagcaga

SEQ ID NO: 3951 - DNA, 25 bp, Homo sapiens
gaaagcagagaaggagggagcagag

SEQ ID NO: 3952 - DNA, 25 bp, Homo sapiens
aaagcagagaaggagggagcagagc

SEQ ID NO: 3953 - DNA, 25 bp, Homo sapiens
aagcagagaaggagggagcagagcc

SEQ ID NO: 3954 - DNA, 25 bp, Homo sapiens
agcagagaaggagggagcagagccc

SEQ ID NO: 3955 - DNA, 25 bp, Homo sapiens
gcagagaaggagggagcagagccca

SEQ ID NO: 3956 - DNA, 25 bp, Homo sapiens
cagagaaggagggagcagagcccac

SEQ ID NO: 3957 - DNA, 25 bp, Homo sapiens
agagaaggagggagcagagcccaca

SEQ ID NO: 3958 - DNA, 25 bp, Homo sapiens
gagaaggagggagcagagcccacaa

SEQ ID NO: 3959 - DNA, 25 bp, Homo sapiens
agaaggagggagcagagcccacaaa

SEQ ID NO: 3960 - DNA, 25 bp, Homo sapiens
gaaggagggagcagagcccacaaac

SEQ ID NO: 3961 - DNA, 25 bp, Homo sapiens
aaggagggagcagagcccacaaaca

SEQ ID NO: 3962 - DNA, 25 bp, Homo sapiens
aggagggagcagagcccacaaacac

SEQ ID NO: 3963 - DNA, 25 bp, Homo sapiens
ggagggagcagagcccacaaacacg

SEQ ID NO: 3964 - DNA, 25 bp, Homo sapiens
gagggagcagagcccacaaacacgg

SEQ ID NO: 3965 - DNA, 25 bp, Homo sapiens
agggagcagagcccacaaacacggt

SEQ ID NO: 3966 - DNA, 25 bp, Homo sapiens
gggagcagagcccacaaacacggtg

SEQ ID NO: 3967 - DNA, 25 bp, Homo sapiens
ggagcagagcccacaaacacggtgg

SEQ ID NO: 3968 - DNA, 25 bp, Homo sapiens
gagcagagcccacaaacacggtgga

SEQ ID NO: 3969 - DNA, 25 bp, Homo sapiens
agcagagcccacaaacacggtggaa

SEQ ID NO: 3970 - DNA, 25 bp, Homo sapiens
gcagagcccacaaacacggtggaaa

SEQ ID NO: 3971 - DNA, 25 bp, Homo sapiens
cagagcccacaaacacggtggaaaa

SEQ ID NO: 3972 - DNA, 25 bp, Homo sapiens
agagcccacaaacacggtggaaaag

SEQ ID NO: 3973 - DNA, 25 bp, Homo sapiens
gagcccacaaacacggtggaaaagg

SEQ ID NO: 3974 - DNA, 25 bp, Homo sapiens
agcccacaaacacggtggaaaaggg

SEQ ID NO: 3975 - DNA, 25 bp, Homo sapiens
gcccacaaacacggtggaaaagggg

SEQ ID NO: 3976 - DNA, 25 bp, Homo sapiens
cccacaaacacggtggaaaagggga

SEQ ID NO: 3977 - DNA, 25 bp, Homo sapiens
ccacaaacacggtggaaaaggggaa

SEQ ID NO: 3978 - DNA, 25 bp, Homo sapiens
cacaaacacggtggaaaaggggaat

SEQ ID NO: 3979 - DNA, 25 bp, Homo sapiens
acaaacacggtggaaaaggggaatg

SEQ ID NO: 3980 - DNA, 25 bp, Homo sapiens
caaacacggtggaaaaggggaatgt

SEQ ID NO: 3981 - DNA, 25 bp, Homo sapiens
aaacacggtggaaaaggggaatgtc

SEQ ID NO: 3982 - DNA, 25 bp, Homo sapiens
aacacggtggaaaaggggaatgtct

SEQ ID NO: 3983 - DNA, 25 bp, Homo sapiens
acacggtggaaaaggggaatgtctc

SEQ ID NO: 3984 - DNA, 25 bp, Homo sapiens
cacggtggaaaaggggaatgtctct

SEQ ID NO: 3985 - DNA, 25 bp, Homo sapiens
acggtggaaaaggggaatgtctcta

SEQ ID NO: 3986 - DNA, 25 bp, Homo sapiens
cggtggaaaaggggaatgtctctaa

SEQ ID NO: 3987 - DNA, 25 bp, Homo sapiens
ggtggaaaaggggaatgtctctaag

SEQ ID NO: 3988 - DNA, 25 bp, Homo sapiens
gtggaaaaggggaatgtctctaagg

SEQ ID NO: 3989 - DNA, 25 bp, Homo sapiens
tggaaaaggggaatgtctctaagga

SEQ ID NO: 3990 - DNA, 25 bp, Homo sapiens
ggaaaaggggaatgtctctaaggac

SEQ ID NO: 3991 - DNA, 25 bp, Homo sapiens
gaaaaggggaatgtctctaaggacg

SEQ ID NO: 3992 - DNA, 25 bp, Homo sapiens
aaaaggggaatgtctctaaggacgt

SEQ ID NO: 3993 - DNA, 25 bp, Homo sapiens
aaaggggaatgtctctaaggacgta

SEQ ID NO: 3994 - DNA, 25 bp, Homo sapiens
aaggggaatgtctctaaggacgtag

SEQ ID NO: 3995 - DNA, 25 bp, Homo sapiens
aggggaatgtctctaaggacgtagg

SEQ ID NO: 3996 - DNA, 25 bp, Homo sapiens
ggggaatgtctctaaggacgtaggg

SEQ ID NO: 3997 - DNA, 25 bp, Homo sapiens
gggaatgtctctaaggacgtaggga

SEQ ID NO: 3998 - DNA, 25 bp, Homo sapiens
ggaatgtctctaaggacgtagggag

SEQ ID NO: 3999 - DNA, 25 bp, Homo sapiens
gaatgtctctaaggacgtagggagt

SEQ ID NO: 4000 - DNA, 25 bp, Homo sapiens
aatgtctctaaggacgtagggagtg

SEQ ID NO: 4001 - DNA, 25 bp, Homo sapiens
atgtctctaaggacgtagggagtga

SEQ ID NO: 4002 - DNA, 25 bp, Homo sapiens
tgtctctaaggacgtagggagtgaa

SEQ ID NO: 4003 - DNA, 25 bp, Homo sapiens
gtctctaaggacgtagggagtgaag

SEQ ID NO: 4004 - DNA, 25 bp, Homo sapiens
tctctaaggacgtagggagtgaagg

SEQ ID NO: 4005 - DNA, 25 bp, Homo sapiens
ctctaaggacgtagggagtgaaggg

SEQ ID NO: 4006 - DNA, 25 bp, Homo sapiens
tctaaggacgtagggagtgaaggga

SEQ ID NO: 4007 - DNA, 25 bp, Homo sapiens
ctaaggacgtagggagtgaagggaa

SEQ ID NO: 4008 - DNA, 25 bp, Homo sapiens
taaggacgtagggagtgaagggaag

SEQ ID NO: 4009 - DNA, 25 bp, Homo sapiens
aaggacgtagggagtgaagggaagc

SEQ ID NO: 4010 - DNA, 25 bp, Homo sapiens
aggacgtagggagtgaagggaagca

SEQ ID NO: 4011 - DNA, 25 bp, Homo sapiens
ggacgtagggagtgaagggaagcac

SEQ ID NO: 4012 - DNA, 25 bp, Homo sapiens
gacgtagggagtgaagggaagcacg

SEQ ID NO: 4013 - DNA, 25 bp, Homo sapiens
acgtagggagtgaagggaagcacgt

SEQ ID NO: 4014 - DNA, 25 bp, Homo sapiens
cgtagggagtgaagggaagcacgta

SEQ ID NO: 4015 - DNA, 25 bp, Homo sapiens
gtagggagtgaagggaagcacgtaa

SEQ ID NO: 4016 - DNA, 25 bp, Homo sapiens
tagggagtgaagggaagcacgtaag

SEQ ID NO: 4017 - DNA, 25 bp, Homo sapiens
agggagtgaagggaagcacgtaagg

SEQ ID NO: 4018 - DNA, 25 bp, Homo sapiens
gggagtgaagggaagcacgtaaggc

SEQ ID NO: 4019 - DNA, 25 bp, Homo sapiens
ggagtgaagggaagcacgtaaggcc

SEQ ID NO: 4020 - DNA, 25 bp, Homo sapiens
gagtgaagggaagcacgtaaggccc

SEQ ID NO: 4021 - DNA, 25 bp, Homo sapiens
agtgaagggaagcacgtaaggcccc

SEQ ID NO: 4022 - DNA, 25 bp, Homo sapiens
gtgaagggaagcacgtaaggcccca

SEQ ID NO: 4023 - DNA, 25 bp, Homo sapiens
tgaagggaagcacgtaaggccccaa

SEQ ID NO: 4024 - DNA, 25 bp, Homo sapiens
gaagggaagcacgtaaggccccaaa

SEQ ID NO: 4025 - DNA, 25 bp, Homo sapiens
aagggaagcacgtaaggccccaaat

SEQ ID NO: 4026 - DNA, 25 bp, Homo sapiens
agggaagcacgtaaggccccaaatc

SEQ ID NO: 4027 - DNA, 25 bp, Homo sapiens
gggaagcacgtaaggccccaaatcc

SEQ ID NO: 4028 - DNA, 25 bp, Homo sapiens
ggaagcacgtaaggccccaaatccc

SEQ ID NO: 4029 - DNA, 25 bp, Homo sapiens
gaagcacgtaaggccccaaatccct

SEQ ID NO: 4030 - DNA, 25 bp, Homo sapiens
aagcacgtaaggccccaaatccctg

SEQ ID NO: 4031 - DNA, 25 bp, Homo sapiens
agcacgtaaggccccaaatccctgg

SEQ ID NO: 4032 - DNA, 25 bp, Homo sapiens
gcacgtaaggccccaaatccctggg

SEQ ID NO: 4033 - DNA, 25 bp, Homo sapiens
cacgtaaggccccaaatccctggga

SEQ ID NO: 4034 - DNA, 25 bp, Homo sapiens
acgtaaggccccaaatccctgggag

SEQ ID NO: 4035 - DNA, 25 bp, Homo sapiens
cgtaaggccccaaatccctgggaga

SEQ ID NO: 4036 - DNA, 25 bp, Homo sapiens
gtaaggccccaaatccctgggagaa

SEQ ID NO: 4037 - DNA, 25 bp, Homo sapiens
taaggccccaaatccctgggagaaa

SEQ ID NO: 4038 - DNA, 25 bp, Homo sapiens
aaggccccaaatccctgggagaaag

SEQ ID NO: 4039 - DNA, 25 bp, Homo sapiens
aggccccaaatccctgggagaaagt

SEQ ID NO: 4040 - DNA, 25 bp, Homo sapiens
ggccccaaatccctgggagaaagtg

SEQ ID NO: 4041 - DNA, 25 bp, Homo sapiens
gccccaaatccctgggagaaagtgg

SEQ ID NO: 4042 - DNA, 25 bp, Homo sapiens
ccccaaatccctgggagaaagtggg

SEQ ID NO: 4043 - DNA, 25 bp, Homo sapiens
cccaaatccctgggagaaagtgggg

SEQ ID NO: 4044 - DNA, 25 bp, Homo sapiens
ccaaatccctgggagaaagtgggga

SEQ ID NO: 4045 - DNA, 25 bp, Homo sapiens
caaatccctgggagaaagtggggag

SEQ ID NO: 4046 - DNA, 25 bp, Homo sapiens
aaatccctgggagaaagtggggagg

SEQ ID NO: 4047 - DNA, 25 bp, Homo sapiens
aatccctgggagaaagtggggaggt

SEQ ID NO: 4048 - DNA, 25 bp, Homo sapiens
atccctgggagaaagtggggaggtt

SEQ ID NO: 4049 - DNA, 25 bp, Homo sapiens
tccctgggagaaagtggggaggttt

SEQ ID NO: 4050 - DNA, 25 bp, Homo sapiens
ccctgggagaaagtggggaggtttc

SEQ ID NO: 4051 - DNA, 25 bp, Homo sapiens
cctgggagaaagtggggaggtttcc

SEQ ID NO: 4052 - DNA, 25 bp, Homo sapiens
ctgggagaaagtggggaggtttcct

SEQ ID NO: 4053 - DNA, 25 bp, Homo sapiens
tgggagaaagtggggaggtttcctg

SEQ ID NO: 4054 - DNA, 25 bp, Homo sapiens
gggagaaagtggggaggtttcctgg

SEQ ID NO: 4055 - DNA, 25 bp, Homo sapiens
ggagaaagtggggaggtttcctggg

SEQ ID NO: 4056 - DNA, 25 bp, Homo sapiens
gagaaagtggggaggtttcctggga

SEQ ID NO: 4057 - DNA, 25 bp, Homo sapiens
agaaagtggggaggtttcctgggaa

SEQ ID NO: 4058 - DNA, 25 bp, Homo sapiens
gaaagtggggaggtttcctgggaag

SEQ ID NO: 4059 - DNA, 25 bp, Homo sapiens
aaagtggggaggtttcctgggaaga

SEQ ID NO: 4060 - DNA, 25 bp, Homo sapiens
aagtggggaggtttcctgggaagaa

SEQ ID NO: 4061 - DNA, 25 bp, Homo sapiens
agtggggaggtttcctgggaagaag

SEQ ID NO: 4062 - DNA, 25 bp, Homo sapiens
gtggggaggtttcctgggaagaagg

SEQ ID NO: 4063 - DNA, 25 bp, Homo sapiens
tggggaggtttcctgggaagaagga

SEQ ID NO: 4064 - DNA, 25 bp, Homo sapiens
ggggaggtttcctgggaagaaggag

SEQ ID NO: 4065 - DNA, 25 bp, Homo sapiens
gggaggtttcctgggaagaaggagt

SEQ ID NO: 4066 - DNA, 25 bp, Homo sapiens
ggaggtttcctgggaagaaggagta

SEQ ID NO: 4067 - DNA, 25 bp, Homo sapiens
gaggtttcctgggaagaaggagtaa

SEQ ID NO: 4068 - DNA, 25 bp, Homo sapiens
aggtttcctgggaagaaggagtaag

SEQ ID NO: 4069 - DNA, 25 bp, Homo sapiens
ggtttcctgggaagaaggagtaagt

SEQ ID NO: 4070 - DNA, 25 bp, Homo sapiens
gtttcctgggaagaaggagtaagtg

SEQ ID NO: 4071 - DNA, 25 bp, Homo sapiens
tttcctgggaagaaggagtaagtgg

SEQ ID NO: 4072 - DNA, 25 bp, Homo sapiens
ttcctgggaagaaggagtaagtggg

SEQ ID NO: 4073 - DNA, 25 bp, Homo sapiens
tcctgggaagaaggagtaagtggga

SEQ ID NO: 4074 - DNA, 25 bp, Homo sapiens
cctgggaagaaggagtaagtgggac

SEQ ID NO: 4075 - DNA, 25 bp, Homo sapiens
ctgggaagaaggagtaagtgggacg

SEQ ID NO: 4076 - DNA, 25 bp, Homo sapiens
tgggaagaaggagtaagtgggacgg

SEQ ID NO: 4077 - DNA, 25 bp, Homo sapiens
gggaagaaggagtaagtgggacggt

SEQ ID NO: 4078 - DNA, 25 bp, Homo sapiens
ggaagaaggagtaagtgggacggtc

SEQ ID NO: 4079 - DNA, 25 bp, Homo sapiens
gaagaaggagtaagtgggacggtcc

SEQ ID NO: 4080 - DNA, 25 bp, Homo sapiens
aagaaggagtaagtgggacggtccc

SEQ ID NO: 4081 - DNA, 25 bp, Homo sapiens
agaaggagtaagtgggacggtcccc

SEQ ID NO: 4082 - DNA, 25 bp, Homo sapiens
gaaggagtaagtgggacggtcccca

SEQ ID NO: 4083 - DNA, 25 bp, Homo sapiens
aaggagtaagtgggacggtccccag

SEQ ID NO: 4084 - DNA, 25 bp, Homo sapiens
aggagtaagtgggacggtccccaga

SEQ ID NO: 4085 - DNA, 25 bp, Homo sapiens
ggagtaagtgggacggtccccagaa

SEQ ID NO: 4086 - DNA, 25 bp, Homo sapiens
gagtaagtgggacggtccccagaat

SEQ ID NO: 4087 - DNA, 25 bp, Homo sapiens
agtaagtgggacggtccccagaata

SEQ ID NO: 4088 - DNA, 25 bp, Homo sapiens
gtaagtgggacggtccccagaataa

SEQ ID NO: 4089 - DNA, 25 bp, Homo sapiens
taagtgggacggtccccagaataag

SEQ ID NO: 4090 - DNA, 25 bp, Homo sapiens
aagtgggacggtccccagaataaga

SEQ ID NO: 4091 - DNA, 25 bp, Homo sapiens
agtgggacggtccccagaataagaa

SEQ ID NO: 4092 - DNA, 25 bp, Homo sapiens
gtgggacggtccccagaataagaag

SEQ ID NO: 4093 - DNA, 25 bp, Homo sapiens
tgggacggtccccagaataagaagg

SEQ ID NO: 4094 - DNA, 25 bp, Homo sapiens
gggacggtccccagaataagaagga

SEQ ID NO: 4095 - DNA, 25 bp, Homo sapiens
ggacggtccccagaataagaaggac

SEQ ID NO: 4096 - DNA, 25 bp, Homo sapiens
gacggtccccagaataagaaggaca

SEQ ID NO: 4097 - DNA, 25 bp, Homo sapiens
acggtccccagaataagaaggacaa

SEQ ID NO: 4098 - DNA, 25 bp, Homo sapiens
cggtccccagaataagaaggacaaa

SEQ ID NO: 4099 - DNA, 25 bp, Homo sapiens
ggtccccagaataagaaggacaaag

SEQ ID NO: 4100 - DNA, 25 bp, Homo sapiens
gtccccagaataagaaggacaaaga

SEQ ID NO: 4101 - DNA, 25 bp, Homo sapiens
tccccagaataagaaggacaaagaa

SEQ ID NO: 4102 - DNA, 25 bp, Homo sapiens
ccccagaataagaaggacaaagaag

SEQ ID NO: 4103 - DNA, 25 bp, Homo sapiens
cccagaataagaaggacaaagaagg

SEQ ID NO: 4104 - DNA, 25 bp, Homo sapiens
ccagaataagaaggacaaagaaggg

SEQ ID NO: 4105 - DNA, 25 bp, Homo sapiens
cagaataagaaggacaaagaagggg

SEQ ID NO: 4106 - DNA, 25 bp, Homo sapiens
agaataagaaggacaaagaaggggt

SEQ ID NO: 4107 - DNA, 25 bp, Homo sapiens
gaataagaaggacaaagaaggggtg

SEQ ID NO: 4108 - DNA, 25 bp, Homo sapiens
aataagaaggacaaagaaggggtgc

SEQ ID NO: 4109 - DNA, 25 bp, Homo sapiens
ataagaaggacaaagaaggggtgct

SEQ ID NO: 4110 - DNA, 25 bp, Homo sapiens
taagaaggacaaagaaggggtgctc

SEQ ID NO: 4111 - DNA, 25 bp, Homo sapiens
aagaaggacaaagaaggggtgctct

SEQ ID NO: 4112 - DNA, 25 bp, Homo sapiens
agaaggacaaagaaggggtgctctt

SEQ ID NO: 4113 - DNA, 25 bp, Homo sapiens
gaaggacaaagaaggggtgctctta

SEQ ID NO: 4114 - DNA, 25 bp, Homo sapiens
aaggacaaagaaggggtgctcttaa

SEQ ID NO: 4115 - DNA, 25 bp, Homo sapiens
aggacaaagaaggggtgctcttaag

SEQ ID NO: 4116 - DNA, 25 bp, Homo sapiens
ggacaaagaaggggtgctcttaagt

SEQ ID NO: 4117 - DNA, 25 bp, Homo sapiens
gacaaagaaggggtgctcttaagta

SEQ ID NO: 4118 - DNA, 25 bp, Homo sapiens
acaaagaaggggtgctcttaagtaa

SEQ ID NO: 4119 - DNA, 25 bp, Homo sapiens
caaagaaggggtgctcttaagtaag

SEQ ID NO: 4120 - DNA, 25 bp, Homo sapiens
aaagaaggggtgctcttaagtaagg

SEQ ID NO: 4121 - DNA, 25 bp, Homo sapiens
aagaaggggtgctcttaagtaaggc

SEQ ID NO: 4122 - DNA, 25 bp, Homo sapiens
agaaggggtgctcttaagtaaggca

SEQ ID NO: 4123 - DNA, 25 bp, Homo sapiens
gaaggggtgctcttaagtaaggcag

SEQ ID NO: 4124 - DNA, 25 bp, Homo sapiens
aaggggtgctcttaagtaaggcaga

SEQ ID NO: 4125 - DNA, 25 bp, Homo sapiens
aggggtgctcttaagtaaggcagag

SEQ ID NO: 4126 - DNA, 25 bp, Homo sapiens
ggggtgctcttaagtaaggcagaga

SEQ ID NO: 4127 - DNA, 25 bp, Homo sapiens
gggtgctcttaagtaaggcagagaa

SEQ ID NO: 4128 - DNA, 25 bp, Homo sapiens
ggtgctcttaagtaaggcagagaag

SEQ ID NO: 4129 - DNA, 25 bp, Homo sapiens
gtgctcttaagtaaggcagagaaga

SEQ ID NO: 4130 - DNA, 25 bp, Homo sapiens
tgctcttaagtaaggcagagaagac

SEQ ID NO: 4131 - DNA, 25 bp, Homo sapiens
gctcttaagtaaggcagagaagaca

SEQ ID NO: 4132 - DNA, 25 bp, Homo sapiens
ctcttaagtaaggcagagaagacag

SEQ ID NO: 4133 - DNA, 25 bp, Homo sapiens
tcttaagtaaggcagagaagacagg

SEQ ID NO: 4134 - DNA, 25 bp, Homo sapiens
cttaagtaaggcagagaagacaggt

SEQ ID NO: 4135 - DNA, 25 bp, Homo sapiens
ttaagtaaggcagagaagacaggtg

SEQ ID NO: 4136 - DNA, 25 bp, Homo sapiens
taagtaaggcagagaagacaggtga

SEQ ID NO: 4137 - DNA, 25 bp, Homo sapiens
aagtaaggcagagaagacaggtgag

SEQ ID NO: 4138 - DNA, 25 bp, Homo sapiens
agtaaggcagagaagacaggtgagc

SEQ ID NO: 4139 - DNA, 25 bp, Homo sapiens
gtaaggcagagaagacaggtgagcc

SEQ ID NO: 4140 - DNA, 25 bp, Homo sapiens
taaggcagagaagacaggtgagcct

SEQ ID NO: 4141 - DNA, 25 bp, Homo sapiens
aaggcagagaagacaggtgagcctc

SEQ ID NO: 4142 - DNA, 25 bp, Homo sapiens
aggcagagaagacaggtgagcctca

SEQ ID NO: 4143 - DNA, 25 bp, Homo sapiens
ggcagagaagacaggtgagcctcag

SEQ ID NO: 4144 - DNA, 25 bp, Homo sapiens
gcagagaagacaggtgagcctcaga

SEQ ID NO: 4145 - DNA, 25 bp, Homo sapiens
cagagaagacaggtgagcctcagac

SEQ ID NO: 4146 - DNA, 25 bp, Homo sapiens
agagaagacaggtgagcctcagacc

SEQ ID NO: 4147 - DNA, 25 bp, Homo sapiens
gagaagacaggtgagcctcagaccc

SEQ ID NO: 4148 - DNA, 25 bp, Homo sapiens
agaagacaggtgagcctcagaccca

SEQ ID NO: 4149 - DNA, 25 bp, Homo sapiens
gaagacaggtgagcctcagacccag

SEQ ID NO: 4150 - DNA, 25 bp, Homo sapiens
aagacaggtgagcctcagacccaga

SEQ ID NO: 4151 - DNA, 25 bp, Homo sapiens
agacaggtgagcctcagacccagat

SEQ ID NO: 4152 - DNA, 25 bp, Homo sapiens
gacaggtgagcctcagacccagatg

SEQ ID NO: 4153 - DNA, 25 bp, Homo sapiens
acaggtgagcctcagacccagatgg

SEQ ID NO: 4154 - DNA, 25 bp, Homo sapiens
caggtgagcctcagacccagatgga

SEQ ID NO: 4155 - DNA, 25 bp, Homo sapiens
aggtgagcctcagacccagatggag

SEQ ID NO: 4156 - DNA, 25 bp, Homo sapiens
ggtgagcctcagacccagatggaga

SEQ ID NO: 4157 - DNA, 25 bp, Homo sapiens
gtgagcctcagacccagatggagaa

SEQ ID NO: 4158 - DNA, 25 bp, Homo sapiens
tgagcctcagacccagatggagaag

SEQ ID NO: 4159 - DNA, 25 bp, Homo sapiens
gagcctcagacccagatggagaaga

SEQ ID NO: 4160 - DNA, 25 bp, Homo sapiens
agcctcagacccagatggagaagac

SEQ ID NO: 4161 - DNA, 25 bp, Homo sapiens
gcctcagacccagatggagaagaca

SEQ ID NO: 4162 - DNA, 25 bp, Homo sapiens
cctcagacccagatggagaagacaa

SEQ ID NO: 4163 - DNA, 25 bp, Homo sapiens
ctcagacccagatggagaagacaag

SEQ ID NO: 4164 - DNA, 25 bp, Homo sapiens
tcagacccagatggagaagacaagc

SEQ ID NO: 4165 - DNA, 25 bp, Homo sapiens
cagacccagatggagaagacaagcc

SEQ ID NO: 4166 - DNA, 25 bp, Homo sapiens
agacccagatggagaagacaagcca

SEQ ID NO: 4167 - DNA, 25 bp, Homo sapiens
gacccagatggagaagacaagccaa

SEQ ID NO: 4168 - DNA, 25 bp, Homo sapiens
acccagatggagaagacaagccaag

SEQ ID NO: 4169 - DNA, 25 bp, Homo sapiens
cccagatggagaagacaagccaagt

SEQ ID NO: 4170 - DNA, 25 bp, Homo sapiens
ccagatggagaagacaagccaagtg

SEQ ID NO: 4171 - DNA, 25 bp, Homo sapiens
cagatggagaagacaagccaagtgc

SEQ ID NO: 4172 - DNA, 25 bp, Homo sapiens
agatggagaagacaagccaagtgca

SEQ ID NO: 4173 - DNA, 25 bp, Homo sapiens
gatggagaagacaagccaagtgcag

SEQ ID NO: 4174 - DNA, 25 bp, Homo sapiens
atggagaagacaagccaagtgcagg

SEQ ID NO: 4175 - DNA, 25 bp, Homo sapiens
tggagaagacaagccaagtgcaggg

SEQ ID NO: 4176 - DNA, 25 bp, Homo sapiens
ggagaagacaagccaagtgcagggc

SEQ ID NO: 4177 - DNA, 25 bp, Homo sapiens
gagaagacaagccaagtgcagggcg

SEQ ID NO: 4178 - DNA, 25 bp, Homo sapiens
agaagacaagccaagtgcagggcga

SEQ ID NO: 4179 - DNA, 25 bp, Homo sapiens
gaagacaagccaagtgcagggcgag

SEQ ID NO: 4180 - DNA, 25 bp, Homo sapiens
aagacaagccaagtgcagggcgagt

SEQ ID NO: 4181 - DNA, 25 bp, Homo sapiens
agacaagccaagtgcagggcgagtt

SEQ ID NO: 4182 - DNA, 25 bp, Homo sapiens
gacaagccaagtgcagggcgagttg

SEQ ID NO: 4183 - DNA, 25 bp, Homo sapiens
acaagccaagtgcagggcgagttgg

SEQ ID NO: 4184 - DNA, 25 bp, Homo sapiens
caagccaagtgcagggcgagttggg

SEQ ID NO: 4185 - DNA, 25 bp, Homo sapiens
aagccaagtgcagggcgagttgggg

SEQ ID NO: 4186 - DNA, 25 bp, Homo sapiens
agccaagtgcagggcgagttggggg

SEQ ID NO: 4187 - DNA, 25 bp, Homo sapiens
gccaagtgcagggcgagttggggga

SEQ ID NO: 4188 - DNA, 25 bp, Homo sapiens
ccaagtgcagggcgagttgggggac

SEQ ID NO: 4189 - DNA, 25 bp, Homo sapiens
caagtgcagggcgagttgggggacg

SEQ ID NO: 4190 - DNA, 25 bp, Homo sapiens
aagtgcagggcgagttgggggacga

SEQ ID NO: 4191 - DNA, 25 bp, Homo sapiens
agtgcagggcgagttgggggacgat

SEQ ID NO: 4192 - DNA, 25 bp, Homo sapiens
gtgcagggcgagttgggggacgatc

SEQ ID NO: 4193 - DNA, 25 bp, Homo sapiens
tgcagggcgagttgggggacgatct

SEQ ID NO: 4194 - DNA, 25 bp, Homo sapiens
gcagggcgagttgggggacgatctg

SEQ ID NO: 4195 - DNA, 25 bp, Homo sapiens
cagggcgagttgggggacgatctga

SEQ ID NO: 4196 - DNA, 25 bp, Homo sapiens
agggcgagttgggggacgatctgag

SEQ ID NO: 4197 - DNA, 25 bp, Homo sapiens
gggcgagttgggggacgatctgaga

SEQ ID NO: 4198 - DNA, 25 bp, Homo sapiens
ggcgagttgggggacgatctgagaa

SEQ ID NO: 4199 - DNA, 25 bp, Homo sapiens
gcgagttgggggacgatctgagaat

SEQ ID NO: 4200 - DNA, 25 bp, Homo sapiens
cgagttgggggacgatctgagaatg

SEQ ID NO: 4201 - DNA, 25 bp, Homo sapiens
gagttgggggacgatctgagaatgg

SEQ ID NO: 4202 - DNA, 25 bp, Homo sapiens
agttgggggacgatctgagaatggg

SEQ ID NO: 4203 - DNA, 25 bp, Homo sapiens
gttgggggacgatctgagaatgggg

SEQ ID NO: 4204 - DNA, 25 bp, Homo sapiens
ttgggggacgatctgagaatggggg

SEQ ID NO: 4205 - DNA, 25 bp, Homo sapiens
tgggggacgatctgagaatggggga

SEQ ID NO: 4206 - DNA, 25 bp, Homo sapiens
gggggacgatctgagaatgggggag

SEQ ID NO: 4207 - DNA, 25 bp, Homo sapiens
ggggacgatctgagaatgggggaga

SEQ ID NO: 4208 - DNA, 25 bp, Homo sapiens
gggacgatctgagaatgggggagaa

SEQ ID NO: 4209 - DNA, 25 bp, Homo sapiens
ggacgatctgagaatgggggagaaa

SEQ ID NO: 4210 - DNA, 25 bp, Homo sapiens
gacgatctgagaatgggggagaaag

SEQ ID NO: 4211 - DNA, 25 bp, Homo sapiens
acgatctgagaatgggggagaaagc

SEQ ID NO: 4212 - DNA, 25 bp, Homo sapiens
cgatctgagaatgggggagaaagca

SEQ ID NO: 4213 - DNA, 25 bp, Homo sapiens
gatctgagaatgggggagaaagcag

SEQ ID NO: 4214 - DNA, 25 bp, Homo sapiens
atctgagaatgggggagaaagcagg

SEQ ID NO: 4215 - DNA, 25 bp, Homo sapiens
tctgagaatgggggagaaagcaggt

SEQ ID NO: 4216 - DNA, 25 bp, Homo sapiens
ctgagaatgggggagaaagcaggtg

SEQ ID NO: 4217 - DNA, 25 bp, Homo sapiens
tgagaatgggggagaaagcaggtga

SEQ ID NO: 4218 - DNA, 25 bp, Homo sapiens
gagaatgggggagaaagcaggtgag

SEQ ID NO: 4219 - DNA, 25 bp, Homo sapiens
agaatgggggagaaagcaggtgagc

SEQ ID NO: 4220 - DNA, 25 bp, Homo sapiens
gaatgggggagaaagcaggtgagct

SEQ ID NO: 4221 - DNA, 25 bp, Homo sapiens
aatgggggagaaagcaggtgagctt

SEQ ID NO: 4222 - DNA, 25 bp, Homo sapiens
atgggggagaaagcaggtgagcttc

SEQ ID NO: 4223 - DNA, 25 bp, Homo sapiens
tgggggagaaagcaggtgagcttcg

SEQ ID NO: 4224 - DNA, 25 bp, Homo sapiens
gggggagaaagcaggtgagcttcgg

SEQ ID NO: 4225 - DNA, 25 bp, Homo sapiens
ggggagaaagcaggtgagcttcgga

SEQ ID NO: 4226 - DNA, 25 bp, Homo sapiens
gggagaaagcaggtgagcttcggag

SEQ ID NO: 4227 - DNA, 25 bp, Homo sapiens
ggagaaagcaggtgagcttcggagc

SEQ ID NO: 4228 - DNA, 25 bp, Homo sapiens
gagaaagcaggtgagcttcggagca

SEQ ID NO: 4229 - DNA, 25 bp, Homo sapiens
agaaagcaggtgagcttcggagcac

SEQ ID NO: 4230 - DNA, 25 bp, Homo sapiens
gaaagcaggtgagcttcggagcacg

SEQ ID NO: 4231 - DNA, 25 bp, Homo sapiens
aaagcaggtgagcttcggagcacga

SEQ ID NO: 4232 - DNA, 25 bp, Homo sapiens
aagcaggtgagcttcggagcacgac

SEQ ID NO: 4233 - DNA, 25 bp, Homo sapiens
agcaggtgagcttcggagcacgact

SEQ ID NO: 4234 - DNA, 25 bp, Homo sapiens
gcaggtgagcttcggagcacgactg

SEQ ID NO: 4235 - DNA, 25 bp, Homo sapiens
caggtgagcttcggagcacgactgg

SEQ ID NO: 4236 - DNA, 25 bp, Homo sapiens
aggtgagcttcggagcacgactggg

SEQ ID NO: 4237 - DNA, 25 bp, Homo sapiens
ggtgagcttcggagcacgactggga

SEQ ID NO: 4238 - DNA, 25 bp, Homo sapiens
gtgagcttcggagcacgactgggaa

SEQ ID NO: 4239 - DNA, 25 bp, Homo sapiens
tgagcttcggagcacgactgggaag

SEQ ID NO: 4240 - DNA, 25 bp, Homo sapiens
gagcttcggagcacgactgggaagg

SEQ ID NO: 4241 - DNA, 25 bp, Homo sapiens
agcttcggagcacgactgggaaggc

SEQ ID NO: 4242 - DNA, 25 bp, Homo sapiens
gcttcggagcacgactgggaaggca

SEQ ID NO: 4243 - DNA, 25 bp, Homo sapiens
cttcggagcacgactgggaaggcag

SEQ ID NO: 4244 - DNA, 25 bp, Homo sapiens
ttcggagcacgactgggaaggcagg

SEQ ID NO: 4245 - DNA, 25 bp, Homo sapiens
tcggagcacgactgggaaggcaggt

SEQ ID NO: 4246 - DNA, 25 bp, Homo sapiens
cggagcacgactgggaaggcaggtg

SEQ ID NO: 4247 - DNA, 25 bp, Homo sapiens
ggagcacgactgggaaggcaggtga

SEQ ID NO: 4248 - DNA, 25 bp, Homo sapiens
gagcacgactgggaaggcaggtgag

SEQ ID NO: 4249 - DNA, 25 bp, Homo sapiens
agcacgactgggaaggcaggtgagt

SEQ ID NO: 4250 - DNA, 25 bp, Homo sapiens
gcacgactgggaaggcaggtgagtc

SEQ ID NO: 4251 - DNA, 25 bp, Homo sapiens
cacgactgggaaggcaggtgagtcc

SEQ ID NO: 4252 - DNA, 25 bp, Homo sapiens
acgactgggaaggcaggtgagtcct

SEQ ID NO: 4253 - DNA, 25 bp, Homo sapiens
cgactgggaaggcaggtgagtcctg

SEQ ID NO: 4254 - DNA, 25 bp, Homo sapiens
gactgggaaggcaggtgagtcctgg

SEQ ID NO: 4255 - DNA, 25 bp, Homo sapiens
actgggaaggcaggtgagtcctggg

SEQ ID NO: 4256 - DNA, 25 bp, Homo sapiens
ctgggaaggcaggtgagtcctggga

SEQ ID NO: 4257 - DNA, 25 bp, Homo sapiens
tgggaaggcaggtgagtcctgggat

SEQ ID NO: 4258 - DNA, 25 bp, Homo sapiens
gggaaggcaggtgagtcctgggata

SEQ ID NO: 4259 - DNA, 25 bp, Homo sapiens
ggaaggcaggtgagtcctgggataa

SEQ ID NO: 4260 - DNA, 25 bp, Homo sapiens
gaaggcaggtgagtcctgggataag

SEQ ID NO: 4261 - DNA, 25 bp, Homo sapiens
aaggcaggtgagtcctgggataaga

SEQ ID NO: 4262 - DNA, 25 bp, Homo sapiens
aggcaggtgagtcctgggataagaa

SEQ ID NO: 4263 - DNA, 25 bp, Homo sapiens
ggcaggtgagtcctgggataagaag

SEQ ID NO: 4264 - DNA, 25 bp, Homo sapiens
gcaggtgagtcctgggataagaagg

SEQ ID NO: 4265 - DNA, 25 bp, Homo sapiens
caggtgagtcctgggataagaagga

SEQ ID NO: 4266 - DNA, 25 bp, Homo sapiens
aggtgagtcctgggataagaaggaa

SEQ ID NO: 4267 - DNA, 25 bp, Homo sapiens
ggtgagtcctgggataagaaggaaa

SEQ ID NO: 4268 - DNA, 25 bp, Homo sapiens
gtgagtcctgggataagaaggaaaa

SEQ ID NO: 4269 - DNA, 25 bp, Homo sapiens
tgagtcctgggataagaaggaaaag

SEQ ID NO: 4270 - DNA, 25 bp, Homo sapiens
gagtcctgggataagaaggaaaaga

SEQ ID NO: 4271 - DNA, 25 bp, Homo sapiens
agtcctgggataagaaggaaaagat

SEQ ID NO: 4272 - DNA, 25 bp, Homo sapiens
gtcctgggataagaaggaaaagatg

SEQ ID NO: 4273 - DNA, 25 bp, Homo sapiens
tcctgggataagaaggaaaagatgg

SEQ ID NO: 4274 - DNA, 25 bp, Homo sapiens
cctgggataagaaggaaaagatggg

SEQ ID NO: 4275 - DNA, 25 bp, Homo sapiens
ctgggataagaaggaaaagatgggg

SEQ ID NO: 4276 - DNA, 25 bp, Homo sapiens
tgggataagaaggaaaagatggggc

SEQ ID NO: 4277 - DNA, 25 bp, Homo sapiens
gggataagaaggaaaagatggggca

SEQ ID NO: 4278 - DNA, 25 bp, Homo sapiens
ggataagaaggaaaagatggggcaa

SEQ ID NO: 4279 - DNA, 25 bp, Homo sapiens
gataagaaggaaaagatggggcaac

SEQ ID NO: 4280 - DNA, 25 bp, Homo sapiens
ataagaaggaaaagatggggcaacc

SEQ ID NO: 4281 - DNA, 25 bp, Homo sapiens
taagaaggaaaagatggggcaaccc

SEQ ID NO: 4282 - DNA, 25 bp, Homo sapiens
aagaaggaaaagatggggcaacccc

SEQ ID NO: 4283 - DNA, 25 bp, Homo sapiens
agaaggaaaagatggggcaacccca

SEQ ID NO: 4284 - DNA, 25 bp, Homo sapiens
gaaggaaaagatggggcaaccccag

SEQ ID NO: 4285 - DNA, 25 bp, Homo sapiens
aaggaaaagatggggcaaccccagg

SEQ ID NO: 4286 - DNA, 25 bp, Homo sapiens
aggaaaagatggggcaaccccaggg

SEQ ID NO: 4287 - DNA, 25 bp, Homo sapiens
ggaaaagatggggcaaccccagggt

SEQ ID NO: 4288 - DNA, 25 bp, Homo sapiens
gaaaagatggggcaaccccagggta

SEQ ID NO: 4289 - DNA, 25 bp, Homo sapiens
aaaagatggggcaaccccagggtaa

SEQ ID NO: 4290 - DNA, 25 bp, Homo sapiens
aaagatggggcaaccccagggtaag

SEQ ID NO: 4291 - DNA, 25 bp, Homo sapiens
aagatggggcaaccccagggtaagt

SEQ ID NO: 4292 - DNA, 25 bp, Homo sapiens
agatggggcaaccccagggtaagtc

SEQ ID NO: 4293 - DNA, 25 bp, Homo sapiens
gatggggcaaccccagggtaagtcc

SEQ ID NO: 4294 - DNA, 25 bp, Homo sapiens
atggggcaaccccagggtaagtccg

SEQ ID NO: 4295 - DNA, 25 bp, Homo sapiens
tggggcaaccccagggtaagtccgg

SEQ ID NO: 4296 - DNA, 25 bp, Homo sapiens
ggggcaaccccagggtaagtccggg

SEQ ID NO: 4297 - DNA, 25 bp, Homo sapiens
gggcaaccccagggtaagtccggga

SEQ ID NO: 4298 - DNA, 25 bp, Homo sapiens
ggcaaccccagggtaagtccgggaa

SEQ ID NO: 4299 - DNA, 25 bp, Homo sapiens
gcaaccccagggtaagtccgggaac

SEQ ID NO: 4300 - DNA, 25 bp, Homo sapiens
caaccccagggtaagtccgggaacg

SEQ ID NO: 4301 - DNA, 25 bp, Homo sapiens
aaccccagggtaagtccgggaacgc

SEQ ID NO: 4302 - DNA, 25 bp, Homo sapiens
accccagggtaagtccgggaacgca

SEQ ID NO: 4303 - DNA, 25 bp, Homo sapiens
ccccagggtaagtccgggaacgcag

SEQ ID NO: 4304 - DNA, 25 bp, Homo sapiens
cccagggtaagtccgggaacgcagg

SEQ ID NO: 4305 - DNA, 25 bp, Homo sapiens
ccagggtaagtccgggaacgcaggt

SEQ ID NO: 4306 - DNA, 25 bp, Homo sapiens
cagggtaagtccgggaacgcaggtg

SEQ ID NO: 4307 - DNA, 25 bp, Homo sapiens
agggtaagtccgggaacgcaggtga

SEQ ID NO: 4308 - DNA, 25 bp, Homo sapiens
gggtaagtccgggaacgcaggtgaa

SEQ ID NO: 4309 - DNA, 25 bp, Homo sapiens
ggtaagtccgggaacgcaggtgaag

SEQ ID NO: 4310 - DNA, 25 bp, Homo sapiens
gtaagtccgggaacgcaggtgaagc

SEQ ID NO: 4311 - DNA, 25 bp, Homo sapiens
taagtccgggaacgcaggtgaagct

SEQ ID NO: 4312 - DNA, 25 bp, Homo sapiens
aagtccgggaacgcaggtgaagctc

SEQ ID NO: 4313 - DNA, 25 bp, Homo sapiens
agtccgggaacgcaggtgaagctcg

SEQ ID NO: 4314 - DNA, 25 bp, Homo sapiens
gtccgggaacgcaggtgaagctcgg

SEQ ID NO: 4315 - DNA, 25 bp, Homo sapiens
tccgggaacgcaggtgaagctcgga

SEQ ID NO: 4316 - DNA, 25 bp, Homo sapiens
ccgggaacgcaggtgaagctcggag

SEQ ID NO: 4317 - DNA, 25 bp, Homo sapiens
cgggaacgcaggtgaagctcggagt

SEQ ID NO: 4318 - DNA, 25 bp, Homo sapiens
gggaacgcaggtgaagctcggagtc

SEQ ID NO: 4319 - DNA, 25 bp, Homo sapiens
ggaacgcaggtgaagctcggagtca

SEQ ID NO: 4320 - DNA, 25 bp, Homo sapiens
gaacgcaggtgaagctcggagtcag

SEQ ID NO: 4321 - DNA, 25 bp, Homo sapiens
aacgcaggtgaagctcggagtcaga

SEQ ID NO: 4322 - DNA, 25 bp, Homo sapiens
acgcaggtgaagctcggagtcagac

SEQ ID NO: 4323 - DNA, 25 bp, Homo sapiens
cgcaggtgaagctcggagtcagaca

SEQ ID NO: 4324 - DNA, 25 bp, Homo sapiens
gcaggtgaagctcggagtcagacag

SEQ ID NO: 4325 - DNA, 25 bp, Homo sapiens
caggtgaagctcggagtcagacaga

SEQ ID NO: 4326 - DNA, 25 bp, Homo sapiens
aggtgaagctcggagtcagacagag

SEQ ID NO: 4327 - DNA, 25 bp, Homo sapiens
ggtgaagctcggagtcagacagaga

SEQ ID NO: 4328 - DNA, 25 bp, Homo sapiens
gtgaagctcggagtcagacagagaa

SEQ ID NO: 4329 - DNA, 25 bp, Homo sapiens
tgaagctcggagtcagacagagaag

SEQ ID NO: 4330 - DNA, 25 bp, Homo sapiens
gaagctcggagtcagacagagaagg

SEQ ID NO: 4331 - DNA, 25 bp, Homo sapiens
aagctcggagtcagacagagaaggg

SEQ ID NO: 4332 - DNA, 25 bp, Homo sapiens
agctcggagtcagacagagaagggc

SEQ ID NO: 4333 - DNA, 25 bp, Homo sapiens
gctcggagtcagacagagaagggct

SEQ ID NO: 4334 - DNA, 25 bp, Homo sapiens
ctcggagtcagacagagaagggctg

SEQ ID NO: 4335 - DNA, 25 bp, Homo sapiens
tcggagtcagacagagaagggctgt

SEQ ID NO: 4336 - DNA, 25 bp, Homo sapiens
cggagtcagacagagaagggctgtg

SEQ ID NO: 4337 - DNA, 25 bp, Homo sapiens
ggagtcagacagagaagggctgtga

SEQ ID NO: 4338 - DNA, 25 bp, Homo sapiens
gagtcagacagagaagggctgtgaa

SEQ ID NO: 4339 - DNA, 25 bp, Homo sapiens
agtcagacagagaagggctgtgaag

SEQ ID NO: 4340 - DNA, 25 bp, Homo sapiens
gtcagacagagaagggctgtgaagc

SEQ ID NO: 4341 - DNA, 25 bp, Homo sapiens
tcagacagagaagggctgtgaagcc

SEQ ID NO: 4342 - DNA, 25 bp, Homo sapiens
cagacagagaagggctgtgaagccc

SEQ ID NO: 4343 - DNA, 25 bp, Homo sapiens
agacagagaagggctgtgaagcccc

SEQ ID NO: 4344 - DNA, 25 bp, Homo sapiens
gacagagaagggctgtgaagcccca

SEQ ID NO: 4345 - DNA, 25 bp, Homo sapiens
acagagaagggctgtgaagccccaa

SEQ ID NO: 4346 - DNA, 25 bp, Homo sapiens
cagagaagggctgtgaagccccaaa

SEQ ID NO: 4347 - DNA, 25 bp, Homo sapiens
agagaagggctgtgaagccccaaag

SEQ ID NO: 4348 - DNA, 25 bp, Homo sapiens
gagaagggctgtgaagccccaaagg

SEQ ID NO: 4349 - DNA, 25 bp, Homo sapiens
agaagggctgtgaagccccaaagga

SEQ ID NO: 4350 - DNA, 25 bp, Homo sapiens
gaagggctgtgaagccccaaaggag

SEQ ID NO: 4351 - DNA, 25 bp, Homo sapiens
aagggctgtgaagccccaaaggagg

SEQ ID NO: 4352 - DNA, 25 bp, Homo sapiens
agggctgtgaagccccaaaggaggt

SEQ ID NO: 4353 - DNA, 25 bp, Homo sapiens
gggctgtgaagccccaaaggaggtg

SEQ ID NO: 4354 - DNA, 25 bp, Homo sapiens
ggctgtgaagccccaaaggaggtga

SEQ ID NO: 4355 - DNA, 25 bp, Homo sapiens
gctgtgaagccccaaaggaggtgag

SEQ ID NO: 4356 - DNA, 25 bp, Homo sapiens
ctgtgaagccccaaaggaggtgagc

SEQ ID NO: 4357 - DNA, 25 bp, Homo sapiens
tgtgaagccccaaaggaggtgagca

SEQ ID NO: 4358 - DNA, 25 bp, Homo sapiens
gtgaagccccaaaggaggtgagcac

SEQ ID NO: 4359 - DNA, 25 bp, Homo sapiens
tgaagccccaaaggaggtgagcaca

SEQ ID NO: 4360 - DNA, 25 bp, Homo sapiens
gaagccccaaaggaggtgagcacaa

SEQ ID NO: 4361 - DNA, 25 bp, Homo sapiens
aagccccaaaggaggtgagcacaat

SEQ ID NO: 4362 - DNA, 25 bp, Homo sapiens
agccccaaaggaggtgagcacaatg

SEQ ID NO: 4363 - DNA, 25 bp, Homo sapiens
gccccaaaggaggtgagcacaatgg

SEQ ID NO: 4364 - DNA, 25 bp, Homo sapiens
ccccaaaggaggtgagcacaatggt

SEQ ID NO: 4365 - DNA, 25 bp, Homo sapiens
cccaaaggaggtgagcacaatggtg

SEQ ID NO: 4366 - DNA, 25 bp, Homo sapiens
ccaaaggaggtgagcacaatggtgg

SEQ ID NO: 4367 - DNA, 25 bp, Homo sapiens
caaaggaggtgagcacaatggtgga

SEQ ID NO: 4368 - DNA, 25 bp, Homo sapiens
aaaggaggtgagcacaatggtggag

SEQ ID NO: 4369 - DNA, 25 bp, Homo sapiens
aaggaggtgagcacaatggtggagt

SEQ ID NO: 4370 - DNA, 25 bp, Homo sapiens
aggaggtgagcacaatggtggagtc

SEQ ID NO: 4371 - DNA, 25 bp, Homo sapiens
ggaggtgagcacaatggtggagtcg

SEQ ID NO: 4372 - DNA, 25 bp, Homo sapiens
gaggtgagcacaatggtggagtcgc

SEQ ID NO: 4373 - DNA, 25 bp, Homo sapiens
aggtgagcacaatggtggagtcgcc

SEQ ID NO: 4374 - DNA, 25 bp, Homo sapiens
ggtgagcacaatggtggagtcgcca

SEQ ID NO: 4375 - DNA, 25 bp, Homo sapiens
gtgagcacaatggtggagtcgccag

SEQ ID NO: 4376 - DNA, 25 bp, Homo sapiens
tgagcacaatggtggagtcgccagc

SEQ ID NO: 4377 - DNA, 25 bp, Homo sapiens
gagcacaatggtggagtcgccagca

SEQ ID NO: 4378 - DNA, 25 bp, Homo sapiens
agcacaatggtggagtcgccagcag

SEQ ID NO: 4379 - DNA, 25 bp, Homo sapiens
gcacaatggtggagtcgccagcagc

SEQ ID NO: 4380 - DNA, 25 bp, Homo sapiens
cacaatggtggagtcgccagcagct

SEQ ID NO: 4381 - DNA, 25 bp, Homo sapiens
acaatggtggagtcgccagcagctc

SEQ ID NO: 4382 - DNA, 25 bp, Homo sapiens
caatggtggagtcgccagcagctcc

SEQ ID NO: 4383 - DNA, 25 bp, Homo sapiens
aatggtggagtcgccagcagctcct

SEQ ID NO: 4384 - DNA, 25 bp, Homo sapiens
atggtggagtcgccagcagctcctg

SEQ ID NO: 4385 - DNA, 25 bp, Homo sapiens
tggtggagtcgccagcagctcctgg

SEQ ID NO: 4386 - DNA, 25 bp, Homo sapiens
ggtggagtcgccagcagctcctggg

SEQ ID NO: 4387 - DNA, 25 bp, Homo sapiens
gtggagtcgccagcagctcctggga

SEQ ID NO: 4388 - DNA, 25 bp, Homo sapiens
tggagtcgccagcagctcctgggaa

SEQ ID NO: 4389 - DNA, 25 bp, Homo sapiens
ggagtcgccagcagctcctgggaag

SEQ ID NO: 4390 - DNA, 25 bp, Homo sapiens
gagtcgccagcagctcctgggaagg

SEQ ID NO: 4391 - DNA, 25 bp, Homo sapiens
agtcgccagcagctcctgggaaggg

SEQ ID NO: 4392 - DNA, 25 bp, Homo sapiens
gtcgccagcagctcctgggaaggga

SEQ ID NO: 4393 - DNA, 25 bp, Homo sapiens
tcgccagcagctcctgggaagggag

SEQ ID NO: 4394 - DNA, 25 bp, Homo sapiens
cgccagcagctcctgggaagggagg

SEQ ID NO: 4395 - DNA, 25 bp, Homo sapiens
gccagcagctcctgggaagggaggc

SEQ ID NO: 4396 - DNA, 25 bp, Homo sapiens
ccagcagctcctgggaagggaggct

SEQ ID NO: 4397 - DNA, 25 bp, Homo sapiens
cagcagctcctgggaagggaggctg

SEQ ID NO: 4398 - DNA, 25 bp, Homo sapiens
agcagctcctgggaagggaggctgg

SEQ ID NO: 4399 - DNA, 25 bp, Homo sapiens
gcagctcctgggaagggaggctggc

SEQ ID NO: 4400 - DNA, 25 bp, Homo sapiens
cagctcctgggaagggaggctggcc

SEQ ID NO: 4401 - DNA, 25 bp, Homo sapiens
agctcctgggaagggaggctggcca

SEQ ID NO: 4402 - DNA, 25 bp, Homo sapiens
gctcctgggaagggaggctggccag

SEQ ID NO: 4403 - DNA, 25 bp, Homo sapiens
ctcctgggaagggaggctggccagg

SEQ ID NO: 4404 - DNA, 25 bp, Homo sapiens
tcctgggaagggaggctggccagga

SEQ ID NO: 4405 - DNA, 25 bp, Homo sapiens
cctgggaagggaggctggccaggaa

SEQ ID NO: 4406 - DNA, 25 bp, Homo sapiens
ctgggaagggaggctggccaggaag

SEQ ID NO: 4407 - DNA, 25 bp, Homo sapiens
tgggaagggaggctggccaggaagc

SEQ ID NO: 4408 - DNA, 25 bp, Homo sapiens
gggaagggaggctggccaggaagcc

SEQ ID NO: 4409 - DNA, 25 bp, Homo sapiens
ggaagggaggctggccaggaagccg

SEQ ID NO: 4410 - DNA, 25 bp, Homo sapiens
gaagggaggctggccaggaagccgt

SEQ ID NO: 4411 - DNA, 25 bp, Homo sapiens
aagggaggctggccaggaagccgtg

SEQ ID NO: 4412 - DNA, 25 bp, Homo sapiens
agggaggctggccaggaagccgtgg

SEQ ID NO: 4413 - DNA, 25 bp, Homo sapiens
gggaggctggccaggaagccgtggg

SEQ ID NO: 4414 - DNA, 25 bp, Homo sapiens
ggaggctggccaggaagccgtgggc

SEQ ID NO: 4415 - DNA, 25 bp, Homo sapiens
gaggctggccaggaagccgtgggca

SEQ ID NO: 4416 - DNA, 25 bp, Homo sapiens
aggctggccaggaagccgtgggcag

SEQ ID NO: 4417 - DNA, 25 bp, Homo sapiens
ggctggccaggaagccgtgggcagg

SEQ ID NO: 4418 - DNA, 25 bp, Homo sapiens
gctggccaggaagccgtgggcagga

SEQ ID NO: 4419 - DNA, 25 bp, Homo sapiens
ctggccaggaagccgtgggcaggaa

SEQ ID NO: 4420 - DNA, 25 bp, Homo sapiens
tggccaggaagccgtgggcaggaag

SEQ ID NO: 4421 - DNA, 25 bp, Homo sapiens
ggccaggaagccgtgggcaggaagc

SEQ ID NO: 4422 - DNA, 25 bp, Homo sapiens
gccaggaagccgtgggcaggaagca

SEQ ID NO: 4423 - DNA, 25 bp, Homo sapiens
ccaggaagccgtgggcaggaagcag

SEQ ID NO: 4424 - DNA, 25 bp, Homo sapiens
caggaagccgtgggcaggaagcaga

SEQ ID NO: 4425 - DNA, 25 bp, Homo sapiens
aggaagccgtgggcaggaagcagag

SEQ ID NO: 4426 - DNA, 25 bp, Homo sapiens
ggaagccgtgggcaggaagcagagg

SEQ ID NO: 4427 - DNA, 25 bp, Homo sapiens
gaagccgtgggcaggaagcagagga

SEQ ID NO: 4428 - DNA, 25 bp, Homo sapiens
aagccgtgggcaggaagcagaggag

SEQ ID NO: 4429 - DNA, 25 bp, Homo sapiens
agccgtgggcaggaagcagaggagc

SEQ ID NO: 4430 - DNA, 25 bp, Homo sapiens
gccgtgggcaggaagcagaggagcc

SEQ ID NO: 4431 - DNA, 25 bp, Homo sapiens
ccgtgggcaggaagcagaggagccc

SEQ ID NO: 4432 - DNA, 25 bp, Homo sapiens
cgtgggcaggaagcagaggagccct

SEQ ID NO: 4433 - DNA, 25 bp, Homo sapiens
gtgggcaggaagcagaggagccctg

SEQ ID NO: 4434 - DNA, 25 bp, Homo sapiens
tgggcaggaagcagaggagccctgc

SEQ ID NO: 4435 - DNA, 25 bp, Homo sapiens
gggcaggaagcagaggagccctgct

SEQ ID NO: 4436 - DNA, 25 bp, Homo sapiens
ggcaggaagcagaggagccctgctc

SEQ ID NO: 4437 - DNA, 25 bp, Homo sapiens
gcaggaagcagaggagccctgctca

SEQ ID NO: 4438 - DNA, 25 bp, Homo sapiens
caggaagcagaggagccctgctcaa

SEQ ID NO: 4439 - DNA, 25 bp, Homo sapiens
aggaagcagaggagccctgctcaag

SEQ ID NO: 4440 - DNA, 25 bp, Homo sapiens
ggaagcagaggagccctgctcaaga

SEQ ID NO: 4441 - DNA, 25 bp, Homo sapiens
gaagcagaggagccctgctcaagag

SEQ ID NO: 4442 - DNA, 25 bp, Homo sapiens
aagcagaggagccctgctcaagagc

SEQ ID NO: 4443 - DNA, 25 bp, Homo sapiens
agcagaggagccctgctcaagagca

SEQ ID NO: 4444 - DNA, 25 bp, Homo sapiens
gcagaggagccctgctcaagagcag

SEQ ID NO: 4445 - DNA, 25 bp, Homo sapiens
cagaggagccctgctcaagagcagg

SEQ ID NO: 4446 - DNA, 25 bp, Homo sapiens
agaggagccctgctcaagagcaggt

SEQ ID NO: 4447 - DNA, 25 bp, Homo sapiens
gaggagccctgctcaagagcaggtg

SEQ ID NO: 4448 - DNA, 25 bp, Homo sapiens
aggagccctgctcaagagcaggtga

SEQ ID NO: 4449 - DNA, 25 bp, Homo sapiens
ggagccctgctcaagagcaggtgat

SEQ ID NO: 4450 - DNA, 25 bp, Homo sapiens
gagccctgctcaagagcaggtgatg

SEQ ID NO: 4451 - DNA, 25 bp, Homo sapiens
agccctgctcaagagcaggtgatgg

SEQ ID NO: 4452 - DNA, 25 bp, Homo sapiens
gccctgctcaagagcaggtgatggg

SEQ ID NO: 4453 - DNA, 25 bp, Homo sapiens
ccctgctcaagagcaggtgatgggg

SEQ ID NO: 4454 - DNA, 25 bp, Homo sapiens
cctgctcaagagcaggtgatggggc

SEQ ID NO: 4455 - DNA, 25 bp, Homo sapiens
ctgctcaagagcaggtgatggggct

SEQ ID NO: 4456 - DNA, 25 bp, Homo sapiens
tgctcaagagcaggtgatggggctg

SEQ ID NO: 4457 - DNA, 25 bp, Homo sapiens
gctcaagagcaggtgatggggctgg

SEQ ID NO: 4458 - DNA, 25 bp, Homo sapiens
ctcaagagcaggtgatggggctggt

SEQ ID NO: 4459 - DNA, 25 bp, Homo sapiens
tcaagagcaggtgatggggctggtg

SEQ ID NO: 4460 - DNA, 25 bp, Homo sapiens
caagagcaggtgatggggctggtgc

SEQ ID NO: 4461 - DNA, 25 bp, Homo sapiens
aagagcaggtgatggggctggtgcc

SEQ ID NO: 4462 - DNA, 25 bp, Homo sapiens
agagcaggtgatggggctggtgccc

SEQ ID NO: 4463 - DNA, 25 bp, Homo sapiens
gagcaggtgatggggctggtgccct

SEQ ID NO: 4464 - DNA, 25 bp, Homo sapiens
agcaggtgatggggctggtgccctg

SEQ ID NO: 4465 - DNA, 25 bp, Homo sapiens
gcaggtgatggggctggtgccctgg

SEQ ID NO: 4466 - DNA, 25 bp, Homo sapiens
caggtgatggggctggtgccctgga

SEQ ID NO: 4467 - DNA, 25 bp, Homo sapiens
aggtgatggggctggtgccctggag

SEQ ID NO: 4468 - DNA, 25 bp, Homo sapiens
ggtgatggggctggtgccctggaga

SEQ ID NO: 4469 - DNA, 25 bp, Homo sapiens
gtgatggggctggtgccctggagac

SEQ ID NO: 4470 - DNA, 25 bp, Homo sapiens
tgatggggctggtgccctggagaca

SEQ ID NO: 4471 - DNA, 25 bp, Homo sapiens
gatggggctggtgccctggagacag

SEQ ID NO: 4472 - DNA, 25 bp, Homo sapiens
atggggctggtgccctggagacaga

SEQ ID NO: 4473 - DNA, 25 bp, Homo sapiens
tggggctggtgccctggagacagag

SEQ ID NO: 4474 - DNA, 25 bp, Homo sapiens
ggggctggtgccctggagacagagc

SEQ ID NO: 4475 - DNA, 25 bp, Homo sapiens
gggctggtgccctggagacagagct

SEQ ID NO: 4476 - DNA, 25 bp, Homo sapiens
ggctggtgccctggagacagagctg

SEQ ID NO: 4477 - DNA, 25 bp, Homo sapiens
gctggtgccctggagacagagctgg

SEQ ID NO: 4478 - DNA, 25 bp, Homo sapiens
ctggtgccctggagacagagctgga

SEQ ID NO: 4479 - DNA, 25 bp, Homo sapiens
tggtgccctggagacagagctggaa

SEQ ID NO: 4480 - DNA, 25 bp, Homo sapiens
ggtgccctggagacagagctggaag

SEQ ID NO: 4481 - DNA, 25 bp, Homo sapiens
gtgccctggagacagagctggaagg

SEQ ID NO: 4482 - DNA, 25 bp, Homo sapiens
tgccctggagacagagctggaagga

SEQ ID NO: 4483 - DNA, 25 bp, Homo sapiens
gccctggagacagagctggaaggac

SEQ ID NO: 4484 - DNA, 25 bp, Homo sapiens
ccctggagacagagctggaaggacc

SEQ ID NO: 4485 - DNA, 25 bp, Homo sapiens
cctggagacagagctggaaggaccc

SEQ ID NO: 4486 - DNA, 25 bp, Homo sapiens
ctggagacagagctggaaggaccca

SEQ ID NO: 4487 - DNA, 25 bp, Homo sapiens
tggagacagagctggaaggacccag

SEQ ID NO: 4488 - DNA, 25 bp, Homo sapiens
ggagacagagctggaaggacccagc

SEQ ID NO: 4489 - DNA, 25 bp, Homo sapiens
gagacagagctggaaggacccagcc

SEQ ID NO: 4490 - DNA, 25 bp, Homo sapiens
agacagagctggaaggacccagcca

SEQ ID NO: 4491 - DNA, 25 bp, Homo sapiens
gacagagctggaaggacccagccag

SEQ ID NO: 4492 - DNA, 25 bp, Homo sapiens
acagagctggaaggacccagccagc

SEQ ID NO: 4493 - DNA, 25 bp, Homo sapiens
cagagctggaaggacccagccagcc

SEQ ID NO: 4494 - DNA, 25 bp, Homo sapiens
agagctggaaggacccagccagcct

SEQ ID NO: 4495 - DNA, 25 bp, Homo sapiens
gagctggaaggacccagccagcctg

SEQ ID NO: 4496 - DNA, 25 bp, Homo sapiens
agctggaaggacccagccagcctgc

SEQ ID NO: 4497 - DNA, 25 bp, Homo sapiens
gctggaaggacccagccagcctgct

SEQ ID NO: 4498 - DNA, 25 bp, Homo sapiens
ctggaaggacccagccagcctgctc

SEQ ID NO: 4499 - DNA, 25 bp, Homo sapiens
tggaaggacccagccagcctgctct

SEQ ID NO: 4500 - DNA, 25 bp, Homo sapiens
ggaaggacccagccagcctgctctg

SEQ ID NO: 4501 - DNA, 25 bp, Homo sapiens
gaaggacccagccagcctgctctgg

SEQ ID NO: 4502 - DNA, 25 bp, Homo sapiens
aaggacccagccagcctgctctgga

SEQ ID NO: 4503 - DNA, 25 bp, Homo sapiens
aggacccagccagcctgctctggag

SEQ ID NO: 4504 - DNA, 25 bp, Homo sapiens
ggacccagccagcctgctctggaga

SEQ ID NO: 4505 - DNA, 25 bp, Homo sapiens
gacccagccagcctgctctggagaa

SEQ ID NO: 4506 - DNA, 25 bp, Homo sapiens
acccagccagcctgctctggagaag

SEQ ID NO: 4507 - DNA, 25 bp, Homo sapiens
cccagccagcctgctctggagaagg

SEQ ID NO: 4508 - DNA, 25 bp, Homo sapiens
ccagccagcctgctctggagaagga

SEQ ID NO: 4509 - DNA, 25 bp, Homo sapiens
cagccagcctgctctggagaaggat

SEQ ID NO: 4510 - DNA, 25 bp, Homo sapiens
agccagcctgctctggagaaggatg

SEQ ID NO: 4511 - DNA, 25 bp, Homo sapiens
gccagcctgctctggagaaggatgc

SEQ ID NO: 4512 - DNA, 25 bp, Homo sapiens
ccagcctgctctggagaaggatgca

SEQ ID NO: 4513 - DNA, 25 bp, Homo sapiens
cagcctgctctggagaaggatgcag

SEQ ID NO: 4514 - DNA, 25 bp, Homo sapiens
agcctgctctggagaaggatgcaga

SEQ ID NO: 4515 - DNA, 25 bp, Homo sapiens
gcctgctctggagaaggatgcagaa

SEQ ID NO: 4516 - DNA, 25 bp, Homo sapiens
cctgctctggagaaggatgcagaaa

SEQ ID NO: 4517 - DNA, 25 bp, Homo sapiens
ctgctctggagaaggatgcagaaag

SEQ ID NO: 4518 - DNA, 25 bp, Homo sapiens
tgctctggagaaggatgcagaaagg

SEQ ID NO: 4519 - DNA, 25 bp, Homo sapiens
gctctggagaaggatgcagaaaggc

SEQ ID NO: 4520 - DNA, 25 bp, Homo sapiens
ctctggagaaggatgcagaaaggcc

SEQ ID NO: 4521 - DNA, 25 bp, Homo sapiens
tctggagaaggatgcagaaaggcct

SEQ ID NO: 4522 - DNA, 25 bp, Homo sapiens
ctggagaaggatgcagaaaggcctc

SEQ ID NO: 4523 - DNA, 25 bp, Homo sapiens
tggagaaggatgcagaaaggcctcg

SEQ ID NO: 4524 - DNA, 25 bp, Homo sapiens
ggagaaggatgcagaaaggcctcgg

SEQ ID NO: 4525 - DNA, 25 bp, Homo sapiens
gagaaggatgcagaaaggcctcgga

SEQ ID NO: 4526 - DNA, 25 bp, Homo sapiens
agaaggatgcagaaaggcctcggat

SEQ ID NO: 4527 - DNA, 25 bp, Homo sapiens
gaaggatgcagaaaggcctcggata

SEQ ID NO: 4528 - DNA, 25 bp, Homo sapiens
aaggatgcagaaaggcctcggatac

SEQ ID NO: 4529 - DNA, 25 bp, Homo sapiens
aggatgcagaaaggcctcggatacg

SEQ ID NO: 4530 - DNA, 25 bp, Homo sapiens
ggatgcagaaaggcctcggatacgg

SEQ ID NO: 4531 - DNA, 25 bp, Homo sapiens
gatgcagaaaggcctcggatacgga

SEQ ID NO: 4532 - DNA, 25 bp, Homo sapiens
atgcagaaaggcctcggatacggaa

SEQ ID NO: 4533 - DNA, 25 bp, Homo sapiens
tgcagaaaggcctcggatacggaag

SEQ ID NO: 4534 - DNA, 25 bp, Homo sapiens
gcagaaaggcctcggatacggaagg

SEQ ID NO: 4535 - DNA, 25 bp, Homo sapiens
cagaaaggcctcggatacggaagga

SEQ ID NO: 4536 - DNA, 25 bp, Homo sapiens
agaaaggcctcggatacggaaggag

SEQ ID NO: 4537 - DNA, 25 bp, Homo sapiens
gaaaggcctcggatacggaaggaga

SEQ ID NO: 4538 - DNA, 25 bp, Homo sapiens
aaaggcctcggatacggaaggagaa

SEQ ID NO: 4539 - DNA, 25 bp, Homo sapiens
aaggcctcggatacggaaggagaac

SEQ ID NO: 4540 - DNA, 25 bp, Homo sapiens
aggcctcggatacggaaggagaacc

SEQ ID NO: 4541 - DNA, 25 bp, Homo sapiens
ggcctcggatacggaaggagaacca

SEQ ID NO: 4542 - DNA, 25 bp, Homo sapiens
gcctcggatacggaaggagaaccaa

SEQ ID NO: 4543 - DNA, 25 bp, Homo sapiens
cctcggatacggaaggagaaccaag

SEQ ID NO: 4544 - DNA, 25 bp, Homo sapiens
ctcggatacggaaggagaaccaaga

SEQ ID NO: 4545 - DNA, 25 bp, Homo sapiens
tcggatacggaaggagaaccaagac

SEQ ID NO: 4546 - DNA, 25 bp, Homo sapiens
cggatacggaaggagaaccaagacg

SEQ ID NO: 4547 - DNA, 25 bp, Homo sapiens
ggatacggaaggagaaccaagacgg

SEQ ID NO: 4548 - DNA, 25 bp, Homo sapiens
gatacggaaggagaaccaagacggg

SEQ ID NO: 4549 - DNA, 25 bp, Homo sapiens
atacggaaggagaaccaagacgggc

SEQ ID NO: 4550 - DNA, 25 bp, Homo sapiens
tacggaaggagaaccaagacgggcc

SEQ ID NO: 4551 - DNA, 25 bp, Homo sapiens
acggaaggagaaccaagacgggcca

SEQ ID NO: 4552 - DNA, 25 bp, Homo sapiens
cggaaggagaaccaagacgggccag

SEQ ID NO: 4553 - DNA, 25 bp, Homo sapiens
ggaaggagaaccaagacgggccagc

SEQ ID NO: 4554 - DNA, 25 bp, Homo sapiens
gaaggagaaccaagacgggccagcc

SEQ ID NO: 4555 - DNA, 25 bp, Homo sapiens
aaggagaaccaagacgggccagccc

SEQ ID NO: 4556 - DNA, 25 bp, Homo sapiens
aggagaaccaagacgggccagcccc

SEQ ID NO: 4557 - DNA, 25 bp, Homo sapiens
ggagaaccaagacgggccagccccg

SEQ ID NO: 4558 - DNA, 25 bp, Homo sapiens
gagaaccaagacgggccagccccgc

SEQ ID NO: 4559 - DNA, 25 bp, Homo sapiens
agaaccaagacgggccagccccgca

SEQ ID NO: 4560 - DNA, 25 bp, Homo sapiens
gaaccaagacgggccagccccgcag

SEQ ID NO: 4561 - DNA, 25 bp, Homo sapiens
aaccaagacgggccagccccgcagg

SEQ ID NO: 4562 - DNA, 25 bp, Homo sapiens
accaagacgggccagccccgcagga

SEQ ID NO: 4563 - DNA, 25 bp, Homo sapiens
ccaagacgggccagccccgcaggag

SEQ ID NO: 4564 - DNA, 25 bp, Homo sapiens
caagacgggccagccccgcaggagg

SEQ ID NO: 4565 - DNA, 25 bp, Homo sapiens
aagacgggccagccccgcaggagga

SEQ ID NO: 4566 - DNA, 25 bp, Homo sapiens
agacgggccagccccgcaggaggag

SEQ ID NO: 4567 - DNA, 25 bp, Homo sapiens
gacgggccagccccgcaggaggagg

SEQ ID NO: 4568 - DNA, 25 bp, Homo sapiens
acgggccagccccgcaggaggaggg

SEQ ID NO: 4569 - DNA, 25 bp, Homo sapiens
cgggccagccccgcaggaggagggc

SEQ ID NO: 4570 - DNA, 25 bp, Homo sapiens
gggccagccccgcaggaggagggca

SEQ ID NO: 4571 - DNA, 25 bp, Homo sapiens
ggccagccccgcaggaggagggcaa

SEQ ID NO: 4572 - DNA, 25 bp, Homo sapiens
gccagccccgcaggaggagggcaaa

SEQ ID NO: 4573 - DNA, 25 bp, Homo sapiens
ccagccccgcaggaggagggcaaag

SEQ ID NO: 4574 - DNA, 25 bp, Homo sapiens
cagccccgcaggaggagggcaaagg

SEQ ID NO: 4575 - DNA, 25 bp, Homo sapiens
agccccgcaggaggagggcaaagga

SEQ ID NO: 4576 - DNA, 25 bp, Homo sapiens
gccccgcaggaggagggcaaaggag

SEQ ID NO: 4577 - DNA, 25 bp, Homo sapiens
ccccgcaggaggagggcaaaggagg

SEQ ID NO: 4578 - DNA, 25 bp, Homo sapiens
cccgcaggaggagggcaaaggaggc

SEQ ID NO: 4579 - DNA, 25 bp, Homo sapiens
ccgcaggaggagggcaaaggaggcc

SEQ ID NO: 4580 - DNA, 25 bp, Homo sapiens
cgcaggaggagggcaaaggaggcca

SEQ ID NO: 4581 - DNA, 25 bp, Homo sapiens
gcaggaggagggcaaaggaggccag

SEQ ID NO: 4582 - DNA, 25 bp, Homo sapiens
caggaggagggcaaaggaggccaga

SEQ ID NO: 4583 - DNA, 25 bp, Homo sapiens
aggaggagggcaaaggaggccagag

SEQ ID NO: 4584 - DNA, 25 bp, Homo sapiens
ggaggagggcaaaggaggccagagc

SEQ ID NO: 4585 - DNA, 25 bp, Homo sapiens
gaggagggcaaaggaggccagagca

SEQ ID NO: 4586 - DNA, 25 bp, Homo sapiens
aggagggcaaaggaggccagagcag

SEQ ID NO: 4587 - DNA, 25 bp, Homo sapiens
ggagggcaaaggaggccagagcaga

SEQ ID NO: 4588 - DNA, 25 bp, Homo sapiens
gagggcaaaggaggccagagcagag

SEQ ID NO: 4589 - DNA, 25 bp, Homo sapiens
agggcaaaggaggccagagcagaga

SEQ ID NO: 4590 - DNA, 25 bp, Homo sapiens
gggcaaaggaggccagagcagagac

SEQ ID NO: 4591 - DNA, 25 bp, Homo sapiens
ggcaaaggaggccagagcagagact

SEQ ID NO: 4592 - DNA, 25 bp, Homo sapiens
gcaaaggaggccagagcagagactc

SEQ ID NO: 4593 - DNA, 25 bp, Homo sapiens
caaaggaggccagagcagagactca

SEQ ID NO: 4594 - DNA, 25 bp, Homo sapiens
aaaggaggccagagcagagactcag

SEQ ID NO: 4595 - DNA, 25 bp, Homo sapiens
aaggaggccagagcagagactcaga

SEQ ID NO: 4596 - DNA, 25 bp, Homo sapiens
aggaggccagagcagagactcagac

SEQ ID NO: 4597 - DNA, 25 bp, Homo sapiens
ggaggccagagcagagactcagacc

SEQ ID NO: 4598 - DNA, 25 bp, Homo sapiens
gaggccagagcagagactcagacca

SEQ ID NO: 4599 - DNA, 25 bp, Homo sapiens
aggccagagcagagactcagaccag

SEQ ID NO: 4600 - DNA, 25 bp, Homo sapiens
ggccagagcagagactcagaccagg

SEQ ID NO: 4601 - DNA, 25 bp, Homo sapiens
gccagagcagagactcagaccaggc

SEQ ID NO: 4602 - DNA, 25 bp, Homo sapiens
ccagagcagagactcagaccaggct

SEQ ID NO: 4603 - DNA, 25 bp, Homo sapiens
cagagcagagactcagaccaggctc

SEQ ID NO: 4604 - DNA, 25 bp, Homo sapiens
agagcagagactcagaccaggctcc

SEQ ID NO: 4605 - DNA, 25 bp, Homo sapiens
gagcagagactcagaccaggctcct

SEQ ID NO: 4606 - DNA, 25 bp, Homo sapiens
agcagagactcagaccaggctcctg

SEQ ID NO: 4607 - DNA, 25 bp, Homo sapiens
gcagagactcagaccaggctcctga

SEQ ID NO: 4608 - DNA, 25 bp, Homo sapiens
cagagactcagaccaggctcctgag

SEQ ID NO: 4609 - DNA, 25 bp, Homo sapiens
agagactcagaccaggctcctgagg

SEQ ID NO: 4610 - DNA, 25 bp, Homo sapiens
gagactcagaccaggctcctgagga

SEQ ID NO: 4611 - DNA, 25 bp, Homo sapiens
agactcagaccaggctcctgaggac

SEQ ID NO: 4612 - DNA, 25 bp, Homo sapiens
gactcagaccaggctcctgaggaca

SEQ ID NO: 4613 - DNA, 25 bp, Homo sapiens
actcagaccaggctcctgaggacag

SEQ ID NO: 4614 - DNA, 25 bp, Homo sapiens
ctcagaccaggctcctgaggacaga

SEQ ID NO: 4615 - DNA, 25 bp, Homo sapiens
tcagaccaggctcctgaggacagat

SEQ ID NO: 4616 - DNA, 25 bp, Homo sapiens
cagaccaggctcctgaggacagatg

SEQ ID NO: 4617 - DNA, 25 bp, Homo sapiens
agaccaggctcctgaggacagatgg

SEQ ID NO: 4618 - DNA, 25 bp, Homo sapiens
gaccaggctcctgaggacagatggt

SEQ ID NO: 4619 - DNA, 25 bp, Homo sapiens
accaggctcctgaggacagatggta

SEQ ID NO: 4620 - DNA, 25 bp, Homo sapiens
ccaggctcctgaggacagatggtat

SEQ ID NO: 4621 - DNA, 25 bp, Homo sapiens
caggctcctgaggacagatggtatg

SEQ ID NO: 4622 - DNA, 25 bp, Homo sapiens
aggctcctgaggacagatggtatga

SEQ ID NO: 4623 - DNA, 25 bp, Homo sapiens
ggctcctgaggacagatggtatgag

SEQ ID NO: 4624 - DNA, 25 bp, Homo sapiens
gctcctgaggacagatggtatgagg

SEQ ID NO: 4625 - DNA, 25 bp, Homo sapiens
ctcctgaggacagatggtatgaggc

SEQ ID NO: 4626 - DNA, 25 bp, Homo sapiens
tcctgaggacagatggtatgaggca

SEQ ID NO: 4627 - DNA, 25 bp, Homo sapiens
cctgaggacagatggtatgaggcag

SEQ ID NO: 4628 - DNA, 25 bp, Homo sapiens
ctgaggacagatggtatgaggcaga

SEQ ID NO: 4629 - DNA, 25 bp, Homo sapiens
tgaggacagatggtatgaggcagag

SEQ ID NO: 4630 - DNA, 25 bp, Homo sapiens
gaggacagatggtatgaggcagaga

SEQ ID NO: 4631 - DNA, 25 bp, Homo sapiens
aggacagatggtatgaggcagagaa

SEQ ID NO: 4632 - DNA, 25 bp, Homo sapiens
ggacagatggtatgaggcagagaaa

SEQ ID NO: 4633 - DNA, 25 bp, Homo sapiens
gacagatggtatgaggcagagaaag

SEQ ID NO: 4634 - DNA, 25 bp, Homo sapiens
acagatggtatgaggcagagaaagt

SEQ ID NO: 4635 - DNA, 25 bp, Homo sapiens
cagatggtatgaggcagagaaagtc

SEQ ID NO: 4636 - DNA, 25 bp, Homo sapiens
agatggtatgaggcagagaaagtct

SEQ ID NO: 4637 - DNA, 25 bp, Homo sapiens
gatggtatgaggcagagaaagtctg

SEQ ID NO: 4638 - DNA, 25 bp, Homo sapiens
atggtatgaggcagagaaagtctgg

SEQ ID NO: 4639 - DNA, 25 bp, Homo sapiens
tggtatgaggcagagaaagtctggc

SEQ ID NO: 4640 - DNA, 25 bp, Homo sapiens
ggtatgaggcagagaaagtctggct

SEQ ID NO: 4641 - DNA, 25 bp, Homo sapiens
gtatgaggcagagaaagtctggctg

SEQ ID NO: 4642 - DNA, 25 bp, Homo sapiens
tatgaggcagagaaagtctggctgg

SEQ ID NO: 4643 - DNA, 25 bp, Homo sapiens
atgaggcagagaaagtctggctggc

SEQ ID NO: 4644 - DNA, 25 bp, Homo sapiens
tgaggcagagaaagtctggctggct

SEQ ID NO: 4645 - DNA, 25 bp, Homo sapiens
gaggcagagaaagtctggctggctc

SEQ ID NO: 4646 - DNA, 25 bp, Homo sapiens
aggcagagaaagtctggctggctca

SEQ ID NO: 4647 - DNA, 25 bp, Homo sapiens
ggcagagaaagtctggctggctcag

SEQ ID NO: 4648 - DNA, 25 bp, Homo sapiens
gcagagaaagtctggctggctcaga

SEQ ID NO: 4649 - DNA, 25 bp, Homo sapiens
cagagaaagtctggctggctcagaa

SEQ ID NO: 4650 - DNA, 25 bp, Homo sapiens
agagaaagtctggctggctcagaag

SEQ ID NO: 4651 - DNA, 25 bp, Homo sapiens
gagaaagtctggctggctcagaagg

SEQ ID NO: 4652 - DNA, 25 bp, Homo sapiens
agaaagtctggctggctcagaagga

SEQ ID NO: 4653 - DNA, 25 bp, Homo sapiens
gaaagtctggctggctcagaaggat

SEQ ID NO: 4654 - DNA, 25 bp, Homo sapiens
aaagtctggctggctcagaaggatg

SEQ ID NO: 4655 - DNA, 25 bp, Homo sapiens
aagtctggctggctcagaaggatgg

SEQ ID NO: 4656 - DNA, 25 bp, Homo sapiens
agtctggctggctcagaaggatgga

SEQ ID NO: 4657 - DNA, 25 bp, Homo sapiens
gtctggctggctcagaaggatggat

SEQ ID NO: 4658 - DNA, 25 bp, Homo sapiens
tctggctggctcagaaggatggatt

SEQ ID NO: 4659 - DNA, 25 bp, Homo sapiens
ctggctggctcagaaggatggattt

SEQ ID NO: 4660 - DNA, 25 bp, Homo sapiens
tggctggctcagaaggatggattta

SEQ ID NO: 4661 - DNA, 25 bp, Homo sapiens
ggctggctcagaaggatggatttac

SEQ ID NO: 4662 - DNA, 25 bp, Homo sapiens
gctggctcagaaggatggatttact

SEQ ID NO: 4663 - DNA, 25 bp, Homo sapiens
ctggctcagaaggatggatttactc

SEQ ID NO: 4664 - DNA, 25 bp, Homo sapiens
tggctcagaaggatggatttactct

SEQ ID NO: 4665 - DNA, 25 bp, Homo sapiens
ggctcagaaggatggatttactctt

SEQ ID NO: 4666 - DNA, 25 bp, Homo sapiens
gctcagaaggatggatttactcttg

SEQ ID NO: 4667 - DNA, 25 bp, Homo sapiens
ctcagaaggatggatttactcttgc

SEQ ID NO: 4668 - DNA, 25 bp, Homo sapiens
tcagaaggatggatttactcttgct

SEQ ID NO: 4669 - DNA, 25 bp, Homo sapiens
cagaaggatggatttactcttgcta

SEQ ID NO: 4670 - DNA, 25 bp, Homo sapiens
agaaggatggatttactcttgctac

SEQ ID NO: 4671 - DNA, 25 bp, Homo sapiens
gaaggatggatttactcttgctacg

SEQ ID NO: 4672 - DNA, 25 bp, Homo sapiens
aaggatggatttactcttgctacgg

SEQ ID NO: 4673 - DNA, 25 bp, Homo sapiens
aggatggatttactcttgctacggt

SEQ ID NO: 4674 - DNA, 25 bp, Homo sapiens
ggatggatttactcttgctacggtg

SEQ ID NO: 4675 - DNA, 25 bp, Homo sapiens
gatggatttactcttgctacggtgc

SEQ ID NO: 4676 - DNA, 25 bp, Homo sapiens
atggatttactcttgctacggtgct

SEQ ID NO: 4677 - DNA, 25 bp, Homo sapiens
tggatttactcttgctacggtgcta

SEQ ID NO: 4678 - DNA, 25 bp, Homo sapiens
ggatttactcttgctacggtgctaa

SEQ ID NO: 4679 - DNA, 25 bp, Homo sapiens
gatttactcttgctacggtgctaaa

SEQ ID NO: 4680 - DNA, 25 bp, Homo sapiens
atttactcttgctacggtgctaaag

SEQ ID NO: 4681 - DNA, 25 bp, Homo sapiens
tttactcttgctacggtgctaaagc

SEQ ID NO: 4682 - DNA, 25 bp, Homo sapiens
ttactcttgctacggtgctaaagcc

SEQ ID NO: 4683 - DNA, 25 bp, Homo sapiens
tactcttgctacggtgctaaagcca

SEQ ID NO: 4684 - DNA, 25 bp, Homo sapiens
actcttgctacggtgctaaagccag

SEQ ID NO: 4685 - DNA, 25 bp, Homo sapiens
ctcttgctacggtgctaaagccaga

SEQ ID NO: 4686 - DNA, 25 bp, Homo sapiens
tcttgctacggtgctaaagccagat

SEQ ID NO: 4687 - DNA, 25 bp, Homo sapiens
cttgctacggtgctaaagccagatg

SEQ ID NO: 4688 - DNA, 25 bp, Homo sapiens
ttgctacggtgctaaagccagatga

SEQ ID NO: 4689 - DNA, 25 bp, Homo sapiens
tgctacggtgctaaagccagatgag

SEQ ID NO: 4690 - DNA, 25 bp, Homo sapiens
gctacggtgctaaagccagatgagg

SEQ ID NO: 4691 - DNA, 25 bp, Homo sapiens
ctacggtgctaaagccagatgaggg

SEQ ID NO: 4692 - DNA, 25 bp, Homo sapiens
tacggtgctaaagccagatgaggga

SEQ ID NO: 4693 - DNA, 25 bp, Homo sapiens
acggtgctaaagccagatgagggaa

SEQ ID NO: 4694 - DNA, 25 bp, Homo sapiens
cggtgctaaagccagatgagggaac

SEQ ID NO: 4695 - DNA, 25 bp, Homo sapiens
ggtgctaaagccagatgagggaaca

SEQ ID NO: 4696 - DNA, 25 bp, Homo sapiens
gtgctaaagccagatgagggaacag

SEQ ID NO: 4697 - DNA, 25 bp, Homo sapiens
tgctaaagccagatgagggaacagc

SEQ ID NO: 4698 - DNA, 25 bp, Homo sapiens
gctaaagccagatgagggaacagca

SEQ ID NO: 4699 - DNA, 25 bp, Homo sapiens
ctaaagccagatgagggaacagcag

SEQ ID NO: 4700 - DNA, 25 bp, Homo sapiens
taaagccagatgagggaacagcaga

SEQ ID NO: 4701 - DNA, 25 bp, Homo sapiens
aaagccagatgagggaacagcagac

SEQ ID NO: 4702 - DNA, 25 bp, Homo sapiens
aagccagatgagggaacagcagacc

SEQ ID NO: 4703 - DNA, 25 bp, Homo sapiens
agccagatgagggaacagcagacct

SEQ ID NO: 4704 - DNA, 25 bp, Homo sapiens
gccagatgagggaacagcagacctg

SEQ ID NO: 4705 - DNA, 25 bp, Homo sapiens
ccagatgagggaacagcagacctgc

SEQ ID NO: 4706 - DNA, 25 bp, Homo sapiens
cagatgagggaacagcagacctgcc

SEQ ID NO: 4707 - DNA, 25 bp, Homo sapiens
agatgagggaacagcagacctgcca

SEQ ID NO: 4708 - DNA, 25 bp, Homo sapiens
gatgagggaacagcagacctgccag

SEQ ID NO: 4709 - DNA, 25 bp, Homo sapiens
atgagggaacagcagacctgccagc

SEQ ID NO: 4710 - DNA, 25 bp, Homo sapiens
tgagggaacagcagacctgccagca

SEQ ID NO: 4711 - DNA, 25 bp, Homo sapiens
gagggaacagcagacctgccagcag

SEQ ID NO: 4712 - DNA, 25 bp, Homo sapiens
agggaacagcagacctgccagcagg

SEQ ID NO: 4713 - DNA, 25 bp, Homo sapiens
gggaacagcagacctgccagcagga

SEQ ID NO: 4714 - DNA, 25 bp, Homo sapiens
ggaacagcagacctgccagcaggaa

SEQ ID NO: 4715 - DNA, 25 bp, Homo sapiens
gaacagcagacctgccagcaggaag

SEQ ID NO: 4716 - DNA, 25 bp, Homo sapiens
aacagcagacctgccagcaggaagg

SEQ ID NO: 4717 - DNA, 25 bp, Homo sapiens
acagcagacctgccagcaggaaggg

SEQ ID NO: 4718 - DNA, 25 bp, Homo sapiens
cagcagacctgccagcaggaagggt

SEQ ID NO: 4719 - DNA, 25 bp, Homo sapiens
agcagacctgccagcaggaagggtg

SEQ ID NO: 4720 - DNA, 25 bp, Homo sapiens
gcagacctgccagcaggaagggtga

SEQ ID NO: 4721 - DNA, 25 bp, Homo sapiens
cagacctgccagcaggaagggtgag

SEQ ID NO: 4722 - DNA, 25 bp, Homo sapiens
agacctgccagcaggaagggtgaga

SEQ ID NO: 4723 - DNA, 25 bp, Homo sapiens
gacctgccagcaggaagggtgagac

SEQ ID NO: 4724 - DNA, 25 bp, Homo sapiens
acctgccagcaggaagggtgagact

SEQ ID NO: 4725 - DNA, 25 bp, Homo sapiens
cctgccagcaggaagggtgagactt

SEQ ID NO: 4726 - DNA, 25 bp, Homo sapiens
ctgccagcaggaagggtgagacttt

SEQ ID NO: 4727 - DNA, 25 bp, Homo sapiens
tgccagcaggaagggtgagactttg

SEQ ID NO: 4728 - DNA, 25 bp, Homo sapiens
gccagcaggaagggtgagactttgc

SEQ ID NO: 4729 - DNA, 25 bp, Homo sapiens
ccagcaggaagggtgagactttgca

SEQ ID NO: 4730 - DNA, 25 bp, Homo sapiens
cagcaggaagggtgagactttgcat

SEQ ID NO: 4731 - DNA, 25 bp, Homo sapiens
agcaggaagggtgagactttgcatt

SEQ ID NO: 4732 - DNA, 25 bp, Homo sapiens
gcaggaagggtgagactttgcattg

SEQ ID NO: 4733 - DNA, 25 bp, Homo sapiens
caggaagggtgagactttgcattga

SEQ ID NO: 4734 - DNA, 25 bp, Homo sapiens
aggaagggtgagactttgcattgat

SEQ ID NO: 4735 - DNA, 25 bp, Homo sapiens
ggaagggtgagactttgcattgatg

SEQ ID NO: 4736 - DNA, 25 bp, Homo sapiens
gaagggtgagactttgcattgatgc

SEQ ID NO: 4737 - DNA, 25 bp, Homo sapiens
aagggtgagactttgcattgatgct

SEQ ID NO: 4738 - DNA, 25 bp, Homo sapiens
agggtgagactttgcattgatgctg

SEQ ID NO: 4739 - DNA, 25 bp, Homo sapiens
gggtgagactttgcattgatgctga

SEQ ID NO: 4740 - DNA, 25 bp, Homo sapiens
ggtgagactttgcattgatgctgac

SEQ ID NO: 4741 - DNA, 25 bp, Homo sapiens
gtgagactttgcattgatgctgaca

SEQ ID NO: 4742 - DNA, 25 bp, Homo sapiens
tgagactttgcattgatgctgacaa

SEQ ID NO: 4743 - DNA, 25 bp, Homo sapiens
gagactttgcattgatgctgacaaa

SEQ ID NO: 4744 - DNA, 25 bp, Homo sapiens
agactttgcattgatgctgacaaaa

SEQ ID NO: 4745 - DNA, 25 bp, Homo sapiens
gactttgcattgatgctgacaaaac

SEQ ID NO: 4746 - DNA, 25 bp, Homo sapiens
actttgcattgatgctgacaaaacc

SEQ ID NO: 4747 - DNA, 25 bp, Homo sapiens
ctttgcattgatgctgacaaaacca

SEQ ID NO: 4748 - DNA, 25 bp, Homo sapiens
tttgcattgatgctgacaaaaccat

SEQ ID NO: 4749 - DNA, 25 bp, Homo sapiens
ttgcattgatgctgacaaaaccatc

SEQ ID NO: 4750 - DNA, 25 bp, Homo sapiens
tgcattgatgctgacaaaaccatca

SEQ ID NO: 4751 - DNA, 25 bp, Homo sapiens
gcattgatgctgacaaaaccatcac

SEQ ID NO: 4752 - DNA, 25 bp, Homo sapiens
cattgatgctgacaaaaccatcact

SEQ ID NO: 4753 - DNA, 25 bp, Homo sapiens
attgatgctgacaaaaccatcactg

SEQ ID NO: 4754 - DNA, 25 bp, Homo sapiens
ttgatgctgacaaaaccatcactga

SEQ ID NO: 4755 - DNA, 25 bp, Homo sapiens
tgatgctgacaaaaccatcactgag

SEQ ID NO: 4756 - DNA, 25 bp, Homo sapiens
gatgctgacaaaaccatcactgagg

SEQ ID NO: 4757 - DNA, 25 bp, Homo sapiens
atgctgacaaaaccatcactgaggt

SEQ ID NO: 4758 - DNA, 25 bp, Homo sapiens
tgctgacaaaaccatcactgaggtg

SEQ ID NO: 4759 - DNA, 25 bp, Homo sapiens
gctgacaaaaccatcactgaggtgg

SEQ ID NO: 4760 - DNA, 25 bp, Homo sapiens
ctgacaaaaccatcactgaggtgga

SEQ ID NO: 4761 - DNA, 25 bp, Homo sapiens
tgacaaaaccatcactgaggtggat

SEQ ID NO: 4762 - DNA, 25 bp, Homo sapiens
gacaaaaccatcactgaggtggatg

SEQ ID NO: 4763 - DNA, 25 bp, Homo sapiens
acaaaaccatcactgaggtggatga

SEQ ID NO: 4764 - DNA, 25 bp, Homo sapiens
caaaaccatcactgaggtggatgag

SEQ ID NO: 4765 - DNA, 25 bp, Homo sapiens
aaaaccatcactgaggtggatgagg

SEQ ID NO: 4766 - DNA, 25 bp, Homo sapiens
aaaccatcactgaggtggatgagga

SEQ ID NO: 4767 - DNA, 25 bp, Homo sapiens
aaccatcactgaggtggatgaggag

SEQ ID NO: 4768 - DNA, 25 bp, Homo sapiens
accatcactgaggtggatgaggagc

SEQ ID NO: 4769 - DNA, 25 bp, Homo sapiens
ccatcactgaggtggatgaggagca

SEQ ID NO: 4770 - DNA, 25 bp, Homo sapiens
catcactgaggtggatgaggagcat

SEQ ID NO: 4771 - DNA, 25 bp, Homo sapiens
atcactgaggtggatgaggagcatg

SEQ ID NO: 4772 - DNA, 25 bp, Homo sapiens
tcactgaggtggatgaggagcatgt

SEQ ID NO: 4773 - DNA, 25 bp, Homo sapiens
cactgaggtggatgaggagcatgtc

SEQ ID NO: 4774 - DNA, 25 bp, Homo sapiens
actgaggtggatgaggagcatgtcc

SEQ ID NO: 4775 - DNA, 25 bp, Homo sapiens
ctgaggtggatgaggagcatgtcca

SEQ ID NO: 4776 - DNA, 25 bp, Homo sapiens
tgaggtggatgaggagcatgtccat

SEQ ID NO: 4777 - DNA, 25 bp, Homo sapiens
gaggtggatgaggagcatgtccatc

SEQ ID NO: 4778 - DNA, 25 bp, Homo sapiens
aggtggatgaggagcatgtccatcg

SEQ ID NO: 4779 - DNA, 25 bp, Homo sapiens
ggtggatgaggagcatgtccatcgg

SEQ ID NO: 4780 - DNA, 25 bp, Homo sapiens
gtggatgaggagcatgtccatcggg

SEQ ID NO: 4781 - DNA, 25 bp, Homo sapiens
tggatgaggagcatgtccatcgggc

SEQ ID NO: 4782 - DNA, 25 bp, Homo sapiens
ggatgaggagcatgtccatcgggcc

SEQ ID NO: 4783 - DNA, 25 bp, Homo sapiens
gatgaggagcatgtccatcgggcca

SEQ ID NO: 4784 - DNA, 25 bp, Homo sapiens
atgaggagcatgtccatcgggccaa

SEQ ID NO: 4785 - DNA, 25 bp, Homo sapiens
tgaggagcatgtccatcgggccaac

SEQ ID NO: 4786 - DNA, 25 bp, Homo sapiens
gaggagcatgtccatcgggccaacc

SEQ ID NO: 4787 - DNA, 25 bp, Homo sapiens
aggagcatgtccatcgggccaaccc

SEQ ID NO: 4788 - DNA, 25 bp, Homo sapiens
ggagcatgtccatcgggccaaccct

SEQ ID NO: 4789 - DNA, 25 bp, Homo sapiens
gagcatgtccatcgggccaaccctc

SEQ ID NO: 4790 - DNA, 25 bp, Homo sapiens
agcatgtccatcgggccaaccctcc

SEQ ID NO: 4791 - DNA, 25 bp, Homo sapiens
gcatgtccatcgggccaaccctcct

SEQ ID NO: 4792 - DNA, 25 bp, Homo sapiens
catgtccatcgggccaaccctcctg

SEQ ID NO: 4793 - DNA, 25 bp, Homo sapiens
atgtccatcgggccaaccctcctga

SEQ ID NO: 4794 - DNA, 25 bp, Homo sapiens
tgtccatcgggccaaccctcctgag

SEQ ID NO: 4795 - DNA, 25 bp, Homo sapiens
gtccatcgggccaaccctcctgagc

SEQ ID NO: 4796 - DNA, 25 bp, Homo sapiens
tccatcgggccaaccctcctgagct

SEQ ID NO: 4797 - DNA, 25 bp, Homo sapiens
ccatcgggccaaccctcctgagctg

SEQ ID NO: 4798 - DNA, 25 bp, Homo sapiens
catcgggccaaccctcctgagctgg

SEQ ID NO: 4799 - DNA, 25 bp, Homo sapiens
atcgggccaaccctcctgagctgga

SEQ ID NO: 4800 - DNA, 25 bp, Homo sapiens
tcgggccaaccctcctgagctggac

SEQ ID NO: 4801 - DNA, 25 bp, Homo sapiens
cgggccaaccctcctgagctggacc

SEQ ID NO: 4802 - DNA, 25 bp, Homo sapiens
gggccaaccctcctgagctggacca

SEQ ID NO: 4803 - DNA, 25 bp, Homo sapiens
ggccaaccctcctgagctggaccag

SEQ ID NO: 4804 - DNA, 25 bp, Homo sapiens
gccaaccctcctgagctggaccagg

SEQ ID NO: 4805 - DNA, 25 bp, Homo sapiens
ccaaccctcctgagctggaccaggt

SEQ ID NO: 4806 - DNA, 25 bp, Homo sapiens
caaccctcctgagctggaccaggtc

SEQ ID NO: 4807 - DNA, 25 bp, Homo sapiens
aaccctcctgagctggaccaggtcg

SEQ ID NO: 4808 - DNA, 25 bp, Homo sapiens
accctcctgagctggaccaggtcga

SEQ ID NO: 4809 - DNA, 25 bp, Homo sapiens
ccctcctgagctggaccaggtcgag

SEQ ID NO: 4810 - DNA, 25 bp, Homo sapiens
cctcctgagctggaccaggtcgagg

SEQ ID NO: 4811 - DNA, 25 bp, Homo sapiens
ctcctgagctggaccaggtcgagga

SEQ ID NO: 4812 - DNA, 25 bp, Homo sapiens
tcctgagctggaccaggtcgaggac

SEQ ID NO: 4813 - DNA, 25 bp, Homo sapiens
cctgagctggaccaggtcgaggacc

SEQ ID NO: 4814 - DNA, 25 bp, Homo sapiens
ctgagctggaccaggtcgaggacct

SEQ ID NO: 4815 - DNA, 25 bp, Homo sapiens
tgagctggaccaggtcgaggacctg

SEQ ID NO: 4816 - DNA, 25 bp, Homo sapiens
gagctggaccaggtcgaggacctgg

SEQ ID NO: 4817 - DNA, 25 bp, Homo sapiens
agctggaccaggtcgaggacctggc

SEQ ID NO: 4818 - DNA, 25 bp, Homo sapiens
gctggaccaggtcgaggacctggcc

SEQ ID NO: 4819 - DNA, 25 bp, Homo sapiens
ctggaccaggtcgaggacctggcct

SEQ ID NO: 4820 - DNA, 25 bp, Homo sapiens
tggaccaggtcgaggacctggcctc

SEQ ID NO: 4821 - DNA, 25 bp, Homo sapiens
ggaccaggtcgaggacctggcctct

SEQ ID NO: 4822 - DNA, 25 bp, Homo sapiens
gaccaggtcgaggacctggcctctc

SEQ ID NO: 4823 - DNA, 25 bp, Homo sapiens
accaggtcgaggacctggcctctct

SEQ ID NO: 4824 - DNA, 25 bp, Homo sapiens
ccaggtcgaggacctggcctctctc

SEQ ID NO: 4825 - DNA, 25 bp, Homo sapiens
caggtcgaggacctggcctctctca

SEQ ID NO: 4826 - DNA, 25 bp, Homo sapiens
aggtcgaggacctggcctctctcat

SEQ ID NO: 4827 - DNA, 25 bp, Homo sapiens
ggtcgaggacctggcctctctcatc

SEQ ID NO: 4828 - DNA, 25 bp, Homo sapiens
gtcgaggacctggcctctctcatca

SEQ ID NO: 4829 - DNA, 25 bp, Homo sapiens
tcgaggacctggcctctctcatcag

SEQ ID NO: 4830 - DNA, 25 bp, Homo sapiens
cgaggacctggcctctctcatcagt

SEQ ID NO: 4831 - DNA, 25 bp, Homo sapiens
gaggacctggcctctctcatcagtg

SEQ ID NO: 4832 - DNA, 25 bp, Homo sapiens
aggacctggcctctctcatcagtgt

SEQ ID NO: 4833 - DNA, 25 bp, Homo sapiens
ggacctggcctctctcatcagtgtc

SEQ ID NO: 4834 - DNA, 25 bp, Homo sapiens
gacctggcctctctcatcagtgtca

SEQ ID NO: 4835 - DNA, 25 bp, Homo sapiens
acctggcctctctcatcagtgtcaa

SEQ ID NO: 4836 - DNA, 25 bp, Homo sapiens
cctggcctctctcatcagtgtcaac

SEQ ID NO: 4837 - DNA, 25 bp, Homo sapiens
ctggcctctctcatcagtgtcaacg

SEQ ID NO: 4838 - DNA, 25 bp, Homo sapiens
tggcctctctcatcagtgtcaacga

SEQ ID NO: 4839 - DNA, 25 bp, Homo sapiens
ggcctctctcatcagtgtcaacgaa

SEQ ID NO: 4840 - DNA, 25 bp, Homo sapiens
gcctctctcatcagtgtcaacgaat

SEQ ID NO: 4841 - DNA, 25 bp, Homo sapiens
cctctctcatcagtgtcaacgaatc

SEQ ID NO: 4842 - DNA, 25 bp, Homo sapiens
ctctctcatcagtgtcaacgaatcc

SEQ ID NO: 4843 - DNA, 25 bp, Homo sapiens
tctctcatcagtgtcaacgaatcca

SEQ ID NO: 4844 - DNA, 25 bp, Homo sapiens
ctctcatcagtgtcaacgaatccag

SEQ ID NO: 4845 - DNA, 25 bp, Homo sapiens
tctcatcagtgtcaacgaatccagt

SEQ ID NO: 4846 - DNA, 25 bp, Homo sapiens
ctcatcagtgtcaacgaatccagtg

SEQ ID NO: 4847 - DNA, 25 bp, Homo sapiens
tcatcagtgtcaacgaatccagtgt

SEQ ID NO: 4848 - DNA, 25 bp, Homo sapiens
catcagtgtcaacgaatccagtgtc

SEQ ID NO: 4849 - DNA, 25 bp, Homo sapiens
atcagtgtcaacgaatccagtgtcc

SEQ ID NO: 4850 - DNA, 25 bp, Homo sapiens
tcagtgtcaacgaatccagtgtcct

SEQ ID NO: 4851 - DNA, 25 bp, Homo sapiens
cagtgtcaacgaatccagtgtcctg

SEQ ID NO: 4852 - DNA, 25 bp, Homo sapiens
agtgtcaacgaatccagtgtcctga

SEQ ID NO: 4853 - DNA, 25 bp, Homo sapiens
gtgtcaacgaatccagtgtcctgaa

SEQ ID NO: 4854 - DNA, 25 bp, Homo sapiens
tgtcaacgaatccagtgtcctgaac

SEQ ID NO: 4855 - DNA, 25 bp, Homo sapiens
gtcaacgaatccagtgtcctgaaca

SEQ ID NO: 4856 - DNA, 25 bp, Homo sapiens
tcaacgaatccagtgtcctgaacac

SEQ ID NO: 4857 - DNA, 25 bp, Homo sapiens
caacgaatccagtgtcctgaacacg

SEQ ID NO: 4858 - DNA, 25 bp, Homo sapiens
aacgaatccagtgtcctgaacacgc

SEQ ID NO: 4859 - DNA, 25 bp, Homo sapiens
acgaatccagtgtcctgaacacgct

SEQ ID NO: 4860 - DNA, 25 bp, Homo sapiens
cgaatccagtgtcctgaacacgctt

SEQ ID NO: 4861 - DNA, 25 bp, Homo sapiens
gaatccagtgtcctgaacacgcttc

SEQ ID NO: 4862 - DNA, 25 bp, Homo sapiens
aatccagtgtcctgaacacgcttct

SEQ ID NO: 4863 - DNA, 25 bp, Homo sapiens
atccagtgtcctgaacacgcttctg

SEQ ID NO: 4864 - DNA, 25 bp, Homo sapiens
tccagtgtcctgaacacgcttctgc

SEQ ID NO: 4865 - DNA, 25 bp, Homo sapiens
ccagtgtcctgaacacgcttctgca

SEQ ID NO: 4866 - DNA, 25 bp, Homo sapiens
cagtgtcctgaacacgcttctgcag

SEQ ID NO: 4867 - DNA, 25 bp, Homo sapiens
agtgtcctgaacacgcttctgcagc

SEQ ID NO: 4868 - DNA, 25 bp, Homo sapiens
gtgtcctgaacacgcttctgcagcg

SEQ ID NO: 4869 - DNA, 25 bp, Homo sapiens
tgtcctgaacacgcttctgcagcgc

SEQ ID NO: 4870 - DNA, 25 bp, Homo sapiens
gtcctgaacacgcttctgcagcgct

SEQ ID NO: 4871 - DNA, 25 bp, Homo sapiens
tcctgaacacgcttctgcagcgcta

SEQ ID NO: 4872 - DNA, 25 bp, Homo sapiens
cctgaacacgcttctgcagcgctac

SEQ ID NO: 4873 - DNA, 25 bp, Homo sapiens
ctgaacacgcttctgcagcgctaca

SEQ ID NO: 4874 - DNA, 25 bp, Homo sapiens
tgaacacgcttctgcagcgctacaa

SEQ ID NO: 4875 - DNA, 25 bp, Homo sapiens
gaacacgcttctgcagcgctacaaa

SEQ ID NO: 4876 - DNA, 25 bp, Homo sapiens
aacacgcttctgcagcgctacaaag

SEQ ID NO: 4877 - DNA, 25 bp, Homo sapiens
acacgcttctgcagcgctacaaagc

SEQ ID NO: 4878 - DNA, 25 bp, Homo sapiens
cacgcttctgcagcgctacaaagct

SEQ ID NO: 4879 - DNA, 25 bp, Homo sapiens
acgcttctgcagcgctacaaagctc

SEQ ID NO: 4880 - DNA, 25 bp, Homo sapiens
cgcttctgcagcgctacaaagctca

SEQ ID NO: 4881 - DNA, 25 bp, Homo sapiens
gcttctgcagcgctacaaagctcag

SEQ ID NO: 4882 - DNA, 25 bp, Homo sapiens
cttctgcagcgctacaaagctcagc

SEQ ID NO: 4883 - DNA, 25 bp, Homo sapiens
ttctgcagcgctacaaagctcagct

SEQ ID NO: 4884 - DNA, 25 bp, Homo sapiens
tctgcagcgctacaaagctcagctg

SEQ ID NO: 4885 - DNA, 25 bp, Homo sapiens
ctgcagcgctacaaagctcagctgc

SEQ ID NO: 4886 - DNA, 25 bp, Homo sapiens
tgcagcgctacaaagctcagctgct

SEQ ID NO: 4887 - DNA, 25 bp, Homo sapiens
gcagcgctacaaagctcagctgctg

SEQ ID NO: 4888 - DNA, 25 bp, Homo sapiens
cagcgctacaaagctcagctgctgc

SEQ ID NO: 4889 - DNA, 25 bp, Homo sapiens
agcgctacaaagctcagctgctgca

SEQ ID NO: 4890 - DNA, 25 bp, Homo sapiens
gcgctacaaagctcagctgctgcac

SEQ ID NO: 4891 - DNA, 25 bp, Homo sapiens
cgctacaaagctcagctgctgcaca

SEQ ID NO: 4892 - DNA, 25 bp, Homo sapiens
gctacaaagctcagctgctgcacac

SEQ ID NO: 4893 - DNA, 25 bp, Homo sapiens
ctacaaagctcagctgctgcacacc

SEQ ID NO: 4894 - DNA, 25 bp, Homo sapiens
tacaaagctcagctgctgcacacct

SEQ ID NO: 4895 - DNA, 25 bp, Homo sapiens
acaaagctcagctgctgcacacctg

SEQ ID NO: 4896 - DNA, 25 bp, Homo sapiens
caaagctcagctgctgcacacctgc

SEQ ID NO: 4897 - DNA, 25 bp, Homo sapiens
aaagctcagctgctgcacacctgca

SEQ ID NO: 4898 - DNA, 25 bp, Homo sapiens
aagctcagctgctgcacacctgcac

SEQ ID NO: 4899 - DNA, 25 bp, Homo sapiens
agctcagctgctgcacacctgcaca

SEQ ID NO: 4900 - DNA, 25 bp, Homo sapiens
gctcagctgctgcacacctgcacag

SEQ ID NO: 4901 - DNA, 25 bp, Homo sapiens
ctcagctgctgcacacctgcacagg

SEQ ID NO: 4902 - DNA, 25 bp, Homo sapiens
tcagctgctgcacacctgcacaggg

SEQ ID NO: 4903 - DNA, 25 bp, Homo sapiens
cagctgctgcacacctgcacagggc

SEQ ID NO: 4904 - DNA, 25 bp, Homo sapiens
agctgctgcacacctgcacagggcc

SEQ ID NO: 4905 - DNA, 25 bp, Homo sapiens
gctgctgcacacctgcacagggcct

SEQ ID NO: 4906 - DNA, 25 bp, Homo sapiens
ctgctgcacacctgcacagggcctg

SEQ ID NO: 4907 - DNA, 25 bp, Homo sapiens
tgctgcacacctgcacagggcctga

SEQ ID NO: 4908 - DNA, 25 bp, Homo sapiens
gctgcacacctgcacagggcctgat

SEQ ID NO: 4909 - DNA, 25 bp, Homo sapiens
ctgcacacctgcacagggcctgatc

SEQ ID NO: 4910 - DNA, 25 bp, Homo sapiens
tgcacacctgcacagggcctgatct

SEQ ID NO: 4911 - DNA, 25 bp, Homo sapiens
gcacacctgcacagggcctgatctg

SEQ ID NO: 4912 - DNA, 25 bp, Homo sapiens
cacacctgcacagggcctgatctga

SEQ ID NO: 4913 - DNA, 25 bp, Homo sapiens
acacctgcacagggcctgatctgat

SEQ ID NO: 4914 - DNA, 25 bp, Homo sapiens
cacctgcacagggcctgatctgatt

SEQ ID NO: 4915 - DNA, 25 bp, Homo sapiens
acctgcacagggcctgatctgattg

SEQ ID NO: 4916 - DNA, 25 bp, Homo sapiens
cctgcacagggcctgatctgattgt

SEQ ID NO: 4917 - DNA, 25 bp, Homo sapiens
ctgcacagggcctgatctgattgtc

SEQ ID NO: 4918 - DNA, 25 bp, Homo sapiens
tgcacagggcctgatctgattgtcc

SEQ ID NO: 4919 - DNA, 25 bp, Homo sapiens
gcacagggcctgatctgattgtcct

SEQ ID NO: 4920 - DNA, 25 bp, Homo sapiens
cacagggcctgatctgattgtcctc

SEQ ID NO: 4921 - DNA, 25 bp, Homo sapiens
acagggcctgatctgattgtcctcc

SEQ ID NO: 4922 - DNA, 25 bp, Homo sapiens
cagggcctgatctgattgtcctcca

SEQ ID NO: 4923 - DNA, 25 bp, Homo sapiens
agggcctgatctgattgtcctccag

SEQ ID NO: 4924 - DNA, 25 bp, Homo sapiens
gggcctgatctgattgtcctccagc

SEQ ID NO: 4925 - DNA, 25 bp, Homo sapiens
ggcctgatctgattgtcctccagcc

SEQ ID NO: 4926 - DNA, 25 bp, Homo sapiens
gcctgatctgattgtcctccagccc

SEQ ID NO: 4927 - DNA, 25 bp, Homo sapiens
cctgatctgattgtcctccagcccc

SEQ ID NO: 4928 - DNA, 25 bp, Homo sapiens
ctgatctgattgtcctccagccccg

SEQ ID NO: 4929 - DNA, 25 bp, Homo sapiens
tgatctgattgtcctccagccccgg

SEQ ID NO: 4930 - DNA, 25 bp, Homo sapiens
gatctgattgtcctccagccccggg

SEQ ID NO: 4931 - DNA, 25 bp, Homo sapiens
atctgattgtcctccagccccgggg

SEQ ID NO: 4932 - DNA, 25 bp, Homo sapiens
tctgattgtcctccagccccggggg

SEQ ID NO: 4933 - DNA, 25 bp, Homo sapiens
ctgattgtcctccagccccgggggc

SEQ ID NO: 4934 - DNA, 25 bp, Homo sapiens
tgattgtcctccagccccgggggcc

SEQ ID NO: 4935 - DNA, 25 bp, Homo sapiens
gattgtcctccagccccgggggccc

SEQ ID NO: 4936 - DNA, 25 bp, Homo sapiens
attgtcctccagccccgggggccct

SEQ ID NO: 4937 - DNA, 25 bp, Homo sapiens
ttgtcctccagccccgggggccctc

SEQ ID NO: 4938 - DNA, 25 bp, Homo sapiens
tgtcctccagccccgggggccctcg

SEQ ID NO: 4939 - DNA, 25 bp, Homo sapiens
gtcctccagccccgggggccctcgg

SEQ ID NO: 4940 - DNA, 25 bp, Homo sapiens
tcctccagccccgggggccctcggt

SEQ ID NO: 4941 - DNA, 25 bp, Homo sapiens
cctccagccccgggggccctcggtg

SEQ ID NO: 4942 - DNA, 25 bp, Homo sapiens
ctccagccccgggggccctcggtgc

SEQ ID NO: 4943 - DNA, 25 bp, Homo sapiens
tccagccccgggggccctcggtgcc

SEQ ID NO: 4944 - DNA, 25 bp, Homo sapiens
ccagccccgggggccctcggtgcct

SEQ ID NO: 4945 - DNA, 25 bp, Homo sapiens
cagccccgggggccctcggtgcctt

SEQ ID NO: 4946 - DNA, 25 bp, Homo sapiens
agccccgggggccctcggtgccttc

SEQ ID NO: 4947 - DNA, 25 bp, Homo sapiens
gccccgggggccctcggtgccttct

SEQ ID NO: 4948 - DNA, 25 bp, Homo sapiens
ccccgggggccctcggtgccttctg

SEQ ID NO: 4949 - DNA, 25 bp, Homo sapiens
cccgggggccctcggtgccttctgc

SEQ ID NO: 4950 - DNA, 25 bp, Homo sapiens
ccgggggccctcggtgccttctgca

SEQ ID NO: 4951 - DNA, 25 bp, Homo sapiens
cgggggccctcggtgccttctgcag

SEQ ID NO: 4952 - DNA, 25 bp, Homo sapiens
gggggccctcggtgccttctgcagg

SEQ ID NO: 4953 - DNA, 25 bp, Homo sapiens
ggggccctcggtgccttctgcaggg

SEQ ID NO: 4954 - DNA, 25 bp, Homo sapiens
gggccctcggtgccttctgcaggga

SEQ ID NO: 4955 - DNA, 25 bp, Homo sapiens
ggccctcggtgccttctgcagggaa

SEQ ID NO: 4956 - DNA, 25 bp, Homo sapiens
gccctcggtgccttctgcagggaag

SEQ ID NO: 4957 - DNA, 25 bp, Homo sapiens
ccctcggtgccttctgcagggaagg

SEQ ID NO: 4958 - DNA, 25 bp, Homo sapiens
cctcggtgccttctgcagggaaggt

SEQ ID NO: 4959 - DNA, 25 bp, Homo sapiens
ctcggtgccttctgcagggaaggtg

SEQ ID NO: 4960 - DNA, 25 bp, Homo sapiens
tcggtgccttctgcagggaaggtgc

SEQ ID NO: 4961 - DNA, 25 bp, Homo sapiens
cggtgccttctgcagggaaggtgcc

SEQ ID NO: 4962 - DNA, 25 bp, Homo sapiens
ggtgccttctgcagggaaggtgccc

SEQ ID NO: 4963 - DNA, 25 bp, Homo sapiens
gtgccttctgcagggaaggtgccca

SEQ ID NO: 4964 - DNA, 25 bp, Homo sapiens
tgccttctgcagggaaggtgcccaa

SEQ ID NO: 4965 - DNA, 25 bp, Homo sapiens
gccttctgcagggaaggtgcccaag

SEQ ID NO: 4966 - DNA, 25 bp, Homo sapiens
ccttctgcagggaaggtgcccaagg

SEQ ID NO: 4967 - DNA, 25 bp, Homo sapiens
cttctgcagggaaggtgcccaaggg

SEQ ID NO: 4968 - DNA, 25 bp, Homo sapiens
ttctgcagggaaggtgcccaagggc

SEQ ID NO: 4969 - DNA, 25 bp, Homo sapiens
tctgcagggaaggtgcccaagggcc

SEQ ID NO: 4970 - DNA, 25 bp, Homo sapiens
ctgcagggaaggtgcccaagggccg

SEQ ID NO: 4971 - DNA, 25 bp, Homo sapiens
tgcagggaaggtgcccaagggccgc

SEQ ID NO: 4972 - DNA, 25 bp, Homo sapiens
gcagggaaggtgcccaagggccgcc

SEQ ID NO: 4973 - DNA, 25 bp, Homo sapiens
cagggaaggtgcccaagggccgccg

SEQ ID NO: 4974 - DNA, 25 bp, Homo sapiens
agggaaggtgcccaagggccgccgg

SEQ ID NO: 4975 - DNA, 25 bp, Homo sapiens
gggaaggtgcccaagggccgccggg

SEQ ID NO: 4976 - DNA, 25 bp, Homo sapiens
ggaaggtgcccaagggccgccggga

SEQ ID NO: 4977 - DNA, 25 bp, Homo sapiens
gaaggtgcccaagggccgccgggat

SEQ ID NO: 4978 - DNA, 25 bp, Homo sapiens
aaggtgcccaagggccgccgggatg

SEQ ID NO: 4979 - DNA, 25 bp, Homo sapiens
aggtgcccaagggccgccgggatgg

SEQ ID NO: 4980 - DNA, 25 bp, Homo sapiens
ggtgcccaagggccgccgggatggc

SEQ ID NO: 4981 - DNA, 25 bp, Homo sapiens
gtgcccaagggccgccgggatggcc

SEQ ID NO: 4982 - DNA, 25 bp, Homo sapiens
tgcccaagggccgccgggatggcct

SEQ ID NO: 4983 - DNA, 25 bp, Homo sapiens
gcccaagggccgccgggatggcctg

SEQ ID NO: 4984 - DNA, 25 bp, Homo sapiens
cccaagggccgccgggatggcctgc

SEQ ID NO: 4985 - DNA, 25 bp, Homo sapiens
ccaagggccgccgggatggcctgcc

SEQ ID NO: 4986 - DNA, 25 bp, Homo sapiens
caagggccgccgggatggcctgcct

SEQ ID NO: 4987 - DNA, 25 bp, Homo sapiens
aagggccgccgggatggcctgcctg

SEQ ID NO: 4988 - DNA, 25 bp, Homo sapiens
agggccgccgggatggcctgcctgc

SEQ ID NO: 4989 - DNA, 25 bp, Homo sapiens
gggccgccgggatggcctgcctgcc

SEQ ID NO: 4990 - DNA, 25 bp, Homo sapiens
ggccgccgggatggcctgcctgccc

SEQ ID NO: 4991 - DNA, 25 bp, Homo sapiens
gccgccgggatggcctgcctgccca

SEQ ID NO: 4992 - DNA, 25 bp, Homo sapiens
ccgccgggatggcctgcctgcccac

SEQ ID NO: 4993 - DNA, 25 bp, Homo sapiens
cgccgggatggcctgcctgcccaca

SEQ ID NO: 4994 - DNA, 25 bp, Homo sapiens
gccgggatggcctgcctgcccacat

SEQ ID NO: 4995 - DNA, 25 bp, Homo sapiens
ccgggatggcctgcctgcccacatt

SEQ ID NO: 4996 - DNA, 25 bp, Homo sapiens
cgggatggcctgcctgcccacattg

SEQ ID NO: 4997 - DNA, 25 bp, Homo sapiens
gggatggcctgcctgcccacattgg

SEQ ID NO: 4998 - DNA, 25 bp, Homo sapiens
ggatggcctgcctgcccacattggc

SEQ ID NO: 4999 - DNA, 25 bp, Homo sapiens
gatggcctgcctgcccacattggct

SEQ ID NO: 5000 - DNA, 25 bp, Homo sapiens
atggcctgcctgcccacattggctc

SEQ ID NO: 5001 - DNA, 25 bp, Homo sapiens
tggcctgcctgcccacattggctcc

SEQ ID NO: 5002 - DNA, 25 bp, Homo sapiens
ggcctgcctgcccacattggctcca

SEQ ID NO: 5003 - DNA, 25 bp, Homo sapiens
gcctgcctgcccacattggctccat

SEQ ID NO: 5004 - DNA, 25 bp, Homo sapiens
cctgcctgcccacattggctccatg

SEQ ID NO: 5005 - DNA, 25 bp, Homo sapiens
ctgcctgcccacattggctccatgg

SEQ ID NO: 5006 - DNA, 25 bp, Homo sapiens
tgcctgcccacattggctccatggc

SEQ ID NO: 5007 - DNA, 25 bp, Homo sapiens
gcctgcccacattggctccatggca

SEQ ID NO: 5008 - DNA, 25 bp, Homo sapiens
cctgcccacattggctccatggcac

SEQ ID NO: 5009 - DNA, 25 bp, Homo sapiens
ctgcccacattggctccatggcaca

SEQ ID NO: 5010 - DNA, 25 bp, Homo sapiens
tgcccacattggctccatggcacag

SEQ ID NO: 5011 - DNA, 25 bp, Homo sapiens
gcccacattggctccatggcacagc

SEQ ID NO: 5012 - DNA, 25 bp, Homo sapiens
cccacattggctccatggcacagcg

SEQ ID NO: 5013 - DNA, 25 bp, Homo sapiens
ccacattggctccatggcacagcgg

SEQ ID NO: 5014 - DNA, 25 bp, Homo sapiens
cacattggctccatggcacagcggg

SEQ ID NO: 5015 - DNA, 25 bp, Homo sapiens
acattggctccatggcacagcgggc

SEQ ID NO: 5016 - DNA, 25 bp, Homo sapiens
cattggctccatggcacagcgggca

SEQ ID NO: 5017 - DNA, 25 bp, Homo sapiens
attggctccatggcacagcgggcat

SEQ ID NO: 5018 - DNA, 25 bp, Homo sapiens
ttggctccatggcacagcgggcata

SEQ ID NO: 5019 - DNA, 25 bp, Homo sapiens
tggctccatggcacagcgggcatac

SEQ ID NO: 5020 - DNA, 25 bp, Homo sapiens
ggctccatggcacagcgggcatact

SEQ ID NO: 5021 - DNA, 25 bp, Homo sapiens
gctccatggcacagcgggcatactg

SEQ ID NO: 5022 - DNA, 25 bp, Homo sapiens
ctccatggcacagcgggcatactgg

SEQ ID NO: 5023 - DNA, 25 bp, Homo sapiens
tccatggcacagcgggcatactggg

SEQ ID NO: 5024 - DNA, 25 bp, Homo sapiens
ccatggcacagcgggcatactgggc

SEQ ID NO: 5025 - DNA, 25 bp, Homo sapiens
catggcacagcgggcatactgggcg

SEQ ID NO: 5026 - DNA, 25 bp, Homo sapiens
atggcacagcgggcatactgggcgc

SEQ ID NO: 5027 - DNA, 25 bp, Homo sapiens
tggcacagcgggcatactgggcgct

SEQ ID NO: 5028 - DNA, 25 bp, Homo sapiens
ggcacagcgggcatactgggcgctg

SEQ ID NO: 5029 - DNA, 25 bp, Homo sapiens
gcacagcgggcatactgggcgctgc

SEQ ID NO: 5030 - DNA, 25 bp, Homo sapiens
cacagcgggcatactgggcgctgct

SEQ ID NO: 5031 - DNA, 25 bp, Homo sapiens
acagcgggcatactgggcgctgctg

SEQ ID NO: 5032 - DNA, 25 bp, Homo sapiens
cagcgggcatactgggcgctgctga

SEQ ID NO: 5033 - DNA, 25 bp, Homo sapiens
agcgggcatactgggcgctgctgaa

SEQ ID NO: 5034 - DNA, 25 bp, Homo sapiens
gcgggcatactgggcgctgctgaac

SEQ ID NO: 5035 - DNA, 25 bp, Homo sapiens
cgggcatactgggcgctgctgaacc

SEQ ID NO: 5036 - DNA, 25 bp, Homo sapiens
gggcatactgggcgctgctgaacca

SEQ ID NO: 5037 - DNA, 25 bp, Homo sapiens
ggcatactgggcgctgctgaaccag

SEQ ID NO: 5038 - DNA, 25 bp, Homo sapiens
gcatactgggcgctgctgaaccagc

SEQ ID NO: 5039 - DNA, 25 bp, Homo sapiens
catactgggcgctgctgaaccagcg

SEQ ID NO: 5040 - DNA, 25 bp, Homo sapiens
atactgggcgctgctgaaccagcgg

SEQ ID NO: 5041 - DNA, 25 bp, Homo sapiens
tactgggcgctgctgaaccagcgga

SEQ ID NO: 5042 - DNA, 25 bp, Homo sapiens
actgggcgctgctgaaccagcggag

SEQ ID NO: 5043 - DNA, 25 bp, Homo sapiens
ctgggcgctgctgaaccagcggaga

SEQ ID NO: 5044 - DNA, 25 bp, Homo sapiens
tgggcgctgctgaaccagcggagag

SEQ ID NO: 5045 - DNA, 25 bp, Homo sapiens
gggcgctgctgaaccagcggagaga

SEQ ID NO: 5046 - DNA, 25 bp, Homo sapiens
ggcgctgctgaaccagcggagagac

SEQ ID NO: 5047 - DNA, 25 bp, Homo sapiens
gcgctgctgaaccagcggagagacc

SEQ ID NO: 5048 - DNA, 25 bp, Homo sapiens
cgctgctgaaccagcggagagacca

SEQ ID NO: 5049 - DNA, 25 bp, Homo sapiens
gctgctgaaccagcggagagaccag

SEQ ID NO: 5050 - DNA, 25 bp, Homo sapiens
ctgctgaaccagcggagagaccaga

SEQ ID NO: 5051 - DNA, 25 bp, Homo sapiens
tgctgaaccagcggagagaccagag

SEQ ID NO: 5052 - DNA, 25 bp, Homo sapiens
gctgaaccagcggagagaccagagc

SEQ ID NO: 5053 - DNA, 25 bp, Homo sapiens
ctgaaccagcggagagaccagagca

SEQ ID NO: 5054 - DNA, 25 bp, Homo sapiens
tgaaccagcggagagaccagagcat

SEQ ID NO: 5055 - DNA, 25 bp, Homo sapiens
gaaccagcggagagaccagagcatt

SEQ ID NO: 5056 - DNA, 25 bp, Homo sapiens
aaccagcggagagaccagagcattg

SEQ ID NO: 5057 - DNA, 25 bp, Homo sapiens
accagcggagagaccagagcattgt

SEQ ID NO: 5058 - DNA, 25 bp, Homo sapiens
ccagcggagagaccagagcattgtg

SEQ ID NO: 5059 - DNA, 25 bp, Homo sapiens
cagcggagagaccagagcattgtgg

SEQ ID NO: 5060 - DNA, 25 bp, Homo sapiens
agcggagagaccagagcattgtggc

SEQ ID NO: 5061 - DNA, 25 bp, Homo sapiens
gcggagagaccagagcattgtggcc

SEQ ID NO: 5062 - DNA, 25 bp, Homo sapiens
cggagagaccagagcattgtggccc

SEQ ID NO: 5063 - DNA, 25 bp, Homo sapiens
ggagagaccagagcattgtggccct

SEQ ID NO: 5064 - DNA, 25 bp, Homo sapiens
gagagaccagagcattgtggccctg

SEQ ID NO: 5065 - DNA, 25 bp, Homo sapiens
agagaccagagcattgtggccctgg

SEQ ID NO: 5066 - DNA, 25 bp, Homo sapiens
gagaccagagcattgtggccctggg

SEQ ID NO: 5067 - DNA, 25 bp, Homo sapiens
agaccagagcattgtggccctgggc

SEQ ID NO: 5068 - DNA, 25 bp, Homo sapiens
gaccagagcattgtggccctgggcc

SEQ ID NO: 5069 - DNA, 25 bp, Homo sapiens
accagagcattgtggccctgggccg

SEQ ID NO: 5070 - DNA, 25 bp, Homo sapiens
ccagagcattgtggccctgggccgg

SEQ ID NO: 5071 - DNA, 25 bp, Homo sapiens
cagagcattgtggccctgggccgga

SEQ ID NO: 5072 - DNA, 25 bp, Homo sapiens
agagcattgtggccctgggccggag

SEQ ID NO: 5073 - DNA, 25 bp, Homo sapiens
gagcattgtggccctgggccggagt

SEQ ID NO: 5074 - DNA, 25 bp, Homo sapiens
agcattgtggccctgggccggagtg

SEQ ID NO: 5075 - DNA, 25 bp, Homo sapiens
gcattgtggccctgggccggagtgg

SEQ ID NO: 5076 - DNA, 25 bp, Homo sapiens
cattgtggccctgggccggagtggc

SEQ ID NO: 5077 - DNA, 25 bp, Homo sapiens
attgtggccctgggccggagtggcg

SEQ ID NO: 5078 - DNA, 25 bp, Homo sapiens
ttgtggccctgggccggagtggcgc

SEQ ID NO: 5079 - DNA, 25 bp, Homo sapiens
tgtggccctgggccggagtggcgct

SEQ ID NO: 5080 - DNA, 25 bp, Homo sapiens
gtggccctgggccggagtggcgctg

SEQ ID NO: 5081 - DNA, 25 bp, Homo sapiens
tggccctgggccggagtggcgctgg

SEQ ID NO: 5082 - DNA, 25 bp, Homo sapiens
ggccctgggccggagtggcgctggg

SEQ ID NO: 5083 - DNA, 25 bp, Homo sapiens
gccctgggccggagtggcgctggga

SEQ ID NO: 5084 - DNA, 25 bp, Homo sapiens
ccctgggccggagtggcgctgggaa

SEQ ID NO: 5085 - DNA, 25 bp, Homo sapiens
cctgggccggagtggcgctgggaag

SEQ ID NO: 5086 - DNA, 25 bp, Homo sapiens
ctgggccggagtggcgctgggaaga

SEQ ID NO: 5087 - DNA, 25 bp, Homo sapiens
tgggccggagtggcgctgggaagac

SEQ ID NO: 5088 - DNA, 25 bp, Homo sapiens
gggccggagtggcgctgggaagacc

SEQ ID NO: 5089 - DNA, 25 bp, Homo sapiens
ggccggagtggcgctgggaagacca

SEQ ID NO: 5090 - DNA, 25 bp, Homo sapiens
gccggagtggcgctgggaagaccac

SEQ ID NO: 5091 - DNA, 25 bp, Homo sapiens
ccggagtggcgctgggaagaccacc

SEQ ID NO: 5092 - DNA, 25 bp, Homo sapiens
cggagtggcgctgggaagaccacct

SEQ ID NO: 5093 - DNA, 25 bp, Homo sapiens
ggagtggcgctgggaagaccacctg

SEQ ID NO: 5094 - DNA, 25 bp, Homo sapiens
gagtggcgctgggaagaccacctgc

SEQ ID NO: 5095 - DNA, 25 bp, Homo sapiens
agtggcgctgggaagaccacctgct

SEQ ID NO: 5096 - DNA, 25 bp, Homo sapiens
gtggcgctgggaagaccacctgctg

SEQ ID NO: 5097 - DNA, 25 bp, Homo sapiens
tggcgctgggaagaccacctgctgt

SEQ ID NO: 5098 - DNA, 25 bp, Homo sapiens
ggcgctgggaagaccacctgctgtg

SEQ ID NO: 5099 - DNA, 25 bp, Homo sapiens
gcgctgggaagaccacctgctgtga

SEQ ID NO: 5100 - DNA, 25 bp, Homo sapiens
cgctgggaagaccacctgctgtgag

SEQ ID NO: 5101 - DNA, 25 bp, Homo sapiens
gctgggaagaccacctgctgtgagc

SEQ ID NO: 5102 - DNA, 25 bp, Homo sapiens
ctgggaagaccacctgctgtgagca

SEQ ID NO: 5103 - DNA, 25 bp, Homo sapiens
tgggaagaccacctgctgtgagcag

SEQ ID NO: 5104 - DNA, 25 bp, Homo sapiens
gggaagaccacctgctgtgagcagg

SEQ ID NO: 5105 - DNA, 25 bp, Homo sapiens
ggaagaccacctgctgtgagcaggt

SEQ ID NO: 5106 - DNA, 25 bp, Homo sapiens
gaagaccacctgctgtgagcaggtc

SEQ ID NO: 5107 - DNA, 25 bp, Homo sapiens
aagaccacctgctgtgagcaggtcc

SEQ ID NO: 5108 - DNA, 25 bp, Homo sapiens
agaccacctgctgtgagcaggtcct

SEQ ID NO: 5109 - DNA, 25 bp, Homo sapiens
gaccacctgctgtgagcaggtcctg

SEQ ID NO: 5110 - DNA, 25 bp, Homo sapiens
accacctgctgtgagcaggtcctgg

SEQ ID NO: 5111 - DNA, 25 bp, Homo sapiens
ccacctgctgtgagcaggtcctgga

SEQ ID NO: 5112 - DNA, 25 bp, Homo sapiens
cacctgctgtgagcaggtcctggaa

SEQ ID NO: 5113 - DNA, 25 bp, Homo sapiens
acctgctgtgagcaggtcctggaac

SEQ ID NO: 5114 - DNA, 25 bp, Homo sapiens
cctgctgtgagcaggtcctggaaca

SEQ ID NO: 5115 - DNA, 25 bp, Homo sapiens
ctgctgtgagcaggtcctggaacac

SEQ ID NO: 5116 - DNA, 25 bp, Homo sapiens
tgctgtgagcaggtcctggaacacc

SEQ ID NO: 5117 - DNA, 25 bp, Homo sapiens
gctgtgagcaggtcctggaacacct

SEQ ID NO: 5118 - DNA, 25 bp, Homo sapiens
ctgtgagcaggtcctggaacacctg

SEQ ID NO: 5119 - DNA, 25 bp, Homo sapiens
tgtgagcaggtcctggaacacctgg

SEQ ID NO: 5120 - DNA, 25 bp, Homo sapiens
gtgagcaggtcctggaacacctggt

SEQ ID NO: 5121 - DNA, 25 bp, Homo sapiens
tgagcaggtcctggaacacctggtg

SEQ ID NO: 5122 - DNA, 25 bp, Homo sapiens
gagcaggtcctggaacacctggtgg

SEQ ID NO: 5123 - DNA, 25 bp, Homo sapiens
agcaggtcctggaacacctggtggg

SEQ ID NO: 5124 - DNA, 25 bp, Homo sapiens
gcaggtcctggaacacctggtgggg

SEQ ID NO: 5125 - DNA, 25 bp, Homo sapiens
caggtcctggaacacctggtgggga

SEQ ID NO: 5126 - DNA, 25 bp, Homo sapiens
aggtcctggaacacctggtggggat

SEQ ID NO: 5127 - DNA, 25 bp, Homo sapiens
ggtcctggaacacctggtggggatg

SEQ ID NO: 5128 - DNA, 25 bp, Homo sapiens
gtcctggaacacctggtggggatgg

SEQ ID NO: 5129 - DNA, 25 bp, Homo sapiens
tcctggaacacctggtggggatggc

SEQ ID NO: 5130 - DNA, 25 bp, Homo sapiens
cctggaacacctggtggggatggca

SEQ ID NO: 5131 - DNA, 25 bp, Homo sapiens
ctggaacacctggtggggatggcag

SEQ ID NO: 5132 - DNA, 25 bp, Homo sapiens
tggaacacctggtggggatggcagg

SEQ ID NO: 5133 - DNA, 25 bp, Homo sapiens
ggaacacctggtggggatggcaggc

SEQ ID NO: 5134 - DNA, 25 bp, Homo sapiens
gaacacctggtggggatggcaggca

SEQ ID NO: 5135 - DNA, 25 bp, Homo sapiens
aacacctggtggggatggcaggcag

SEQ ID NO: 5136 - DNA, 25 bp, Homo sapiens
acacctggtggggatggcaggcagt

SEQ ID NO: 5137 - DNA, 25 bp, Homo sapiens
cacctggtggggatggcaggcagtg

SEQ ID NO: 5138 - DNA, 25 bp, Homo sapiens
acctggtggggatggcaggcagtgt

SEQ ID NO: 5139 - DNA, 25 bp, Homo sapiens
cctggtggggatggcaggcagtgtg

SEQ ID NO: 5140 - DNA, 25 bp, Homo sapiens
ctggtggggatggcaggcagtgtgg

SEQ ID NO: 5141 - DNA, 25 bp, Homo sapiens
tggtggggatggcaggcagtgtgga

SEQ ID NO: 5142 - DNA, 25 bp, Homo sapiens
ggtggggatggcaggcagtgtggat

SEQ ID NO: 5143 - DNA, 25 bp, Homo sapiens
gtggggatggcaggcagtgtggatg

SEQ ID NO: 5144 - DNA, 25 bp, Homo sapiens
tggggatggcaggcagtgtggatgg

SEQ ID NO: 5145 - DNA, 25 bp, Homo sapiens
ggggatggcaggcagtgtggatggc

SEQ ID NO: 5146 - DNA, 25 bp, Homo sapiens
gggatggcaggcagtgtggatggca

SEQ ID NO: 5147 - DNA, 25 bp, Homo sapiens
ggatggcaggcagtgtggatggcag

SEQ ID NO: 5148 - DNA, 25 bp, Homo sapiens
gatggcaggcagtgtggatggcagg

SEQ ID NO: 5149 - DNA, 25 bp, Homo sapiens
atggcaggcagtgtggatggcaggg

SEQ ID NO: 5150 - DNA, 25 bp, Homo sapiens
tggcaggcagtgtggatggcagggt

SEQ ID NO: 5151 - DNA, 25 bp, Homo sapiens
ggcaggcagtgtggatggcagggtc

SEQ ID NO: 5152 - DNA, 25 bp, Homo sapiens
gcaggcagtgtggatggcagggtct

SEQ ID NO: 5153 - DNA, 25 bp, Homo sapiens
caggcagtgtggatggcagggtctc

SEQ ID NO: 5154 - DNA, 25 bp, Homo sapiens
aggcagtgtggatggcagggtctca

SEQ ID NO: 5155 - DNA, 25 bp, Homo sapiens
ggcagtgtggatggcagggtctcag

SEQ ID NO: 5156 - DNA, 25 bp, Homo sapiens
gcagtgtggatggcagggtctcagt

SEQ ID NO: 5157 - DNA, 25 bp, Homo sapiens
cagtgtggatggcagggtctcagtg

SEQ ID NO: 5158 - DNA, 25 bp, Homo sapiens
agtgtggatggcagggtctcagtgg

SEQ ID NO: 5159 - DNA, 25 bp, Homo sapiens
gtgtggatggcagggtctcagtgga

SEQ ID NO: 5160 - DNA, 25 bp, Homo sapiens
tgtggatggcagggtctcagtggag

SEQ ID NO: 5161 - DNA, 25 bp, Homo sapiens
gtggatggcagggtctcagtggaga

SEQ ID NO: 5162 - DNA, 25 bp, Homo sapiens
tggatggcagggtctcagtggagaa

SEQ ID NO: 5163 - DNA, 25 bp, Homo sapiens
ggatggcagggtctcagtggagaag

SEQ ID NO: 5164 - DNA, 25 bp, Homo sapiens
gatggcagggtctcagtggagaaga

SEQ ID NO: 5165 - DNA, 25 bp, Homo sapiens
atggcagggtctcagtggagaagat

SEQ ID NO: 5166 - DNA, 25 bp, Homo sapiens
tggcagggtctcagtggagaagatc

SEQ ID NO: 5167 - DNA, 25 bp, Homo sapiens
ggcagggtctcagtggagaagatcc

SEQ ID NO: 5168 - DNA, 25 bp, Homo sapiens
gcagggtctcagtggagaagatccg

SEQ ID NO: 5169 - DNA, 25 bp, Homo sapiens
cagggtctcagtggagaagatccga

SEQ ID NO: 5170 - DNA, 25 bp, Homo sapiens
agggtctcagtggagaagatccgag

SEQ ID NO: 5171 - DNA, 25 bp, Homo sapiens
gggtctcagtggagaagatccgagc

SEQ ID NO: 5172 - DNA, 25 bp, Homo sapiens
ggtctcagtggagaagatccgagcc

SEQ ID NO: 5173 - DNA, 25 bp, Homo sapiens
gtctcagtggagaagatccgagcca

SEQ ID NO: 5174 - DNA, 25 bp, Homo sapiens
tctcagtggagaagatccgagccac

SEQ ID NO: 5175 - DNA, 25 bp, Homo sapiens
ctcagtggagaagatccgagccacc

SEQ ID NO: 5176 - DNA, 25 bp, Homo sapiens
tcagtggagaagatccgagccacct

SEQ ID NO: 5177 - DNA, 25 bp, Homo sapiens
cagtggagaagatccgagccacctt

SEQ ID NO: 5178 - DNA, 25 bp, Homo sapiens
agtggagaagatccgagccaccttc

SEQ ID NO: 5179 - DNA, 25 bp, Homo sapiens
gtggagaagatccgagccaccttca

SEQ ID NO: 5180 - DNA, 25 bp, Homo sapiens
tggagaagatccgagccaccttcac

SEQ ID NO: 5181 - DNA, 25 bp, Homo sapiens
ggagaagatccgagccaccttcact

SEQ ID NO: 5182 - DNA, 25 bp, Homo sapiens
gagaagatccgagccaccttcactg

SEQ ID NO: 5183 - DNA, 25 bp, Homo sapiens
agaagatccgagccaccttcactgt

SEQ ID NO: 5184 - DNA, 25 bp, Homo sapiens
gaagatccgagccaccttcactgtc

SEQ ID NO: 5185 - DNA, 25 bp, Homo sapiens
aagatccgagccaccttcactgtcc

SEQ ID NO: 5186 - DNA, 25 bp, Homo sapiens
agatccgagccaccttcactgtcct

SEQ ID NO: 5187 - DNA, 25 bp, Homo sapiens
gatccgagccaccttcactgtcctc

SEQ ID NO: 5188 - DNA, 25 bp, Homo sapiens
atccgagccaccttcactgtcctcc

SEQ ID NO: 5189 - DNA, 25 bp, Homo sapiens
tccgagccaccttcactgtcctccg

SEQ ID NO: 5190 - DNA, 25 bp, Homo sapiens
ccgagccaccttcactgtcctccgg

SEQ ID NO: 5191 - DNA, 25 bp, Homo sapiens
cgagccaccttcactgtcctccggg

SEQ ID NO: 5192 - DNA, 25 bp, Homo sapiens
gagccaccttcactgtcctccgggc

SEQ ID NO: 5193 - DNA, 25 bp, Homo sapiens
agccaccttcactgtcctccgggcc

SEQ ID NO: 5194 - DNA, 25 bp, Homo sapiens
gccaccttcactgtcctccgggcct

SEQ ID NO: 5195 - DNA, 25 bp, Homo sapiens
ccaccttcactgtcctccgggcctt

SEQ ID NO: 5196 - DNA, 25 bp, Homo sapiens
caccttcactgtcctccgggccttc

SEQ ID NO: 5197 - DNA, 25 bp, Homo sapiens
accttcactgtcctccgggccttcg

SEQ ID NO: 5198 - DNA, 25 bp, Homo sapiens
ccttcactgtcctccgggccttcgg

SEQ ID NO: 5199 - DNA, 25 bp, Homo sapiens
cttcactgtcctccgggccttcggc

SEQ ID NO: 5200 - DNA, 25 bp, Homo sapiens
ttcactgtcctccgggccttcggct

SEQ ID NO: 5201 - DNA, 25 bp, Homo sapiens
tcactgtcctccgggccttcggctc

SEQ ID NO: 5202 - DNA, 25 bp, Homo sapiens
cactgtcctccgggccttcggctct

SEQ ID NO: 5203 - DNA, 25 bp, Homo sapiens
actgtcctccgggccttcggctctg

SEQ ID NO: 5204 - DNA, 25 bp, Homo sapiens
ctgtcctccgggccttcggctctgt

SEQ ID NO: 5205 - DNA, 25 bp, Homo sapiens
tgtcctccgggccttcggctctgtg

SEQ ID NO: 5206 - DNA, 25 bp, Homo sapiens
gtcctccgggccttcggctctgtgt

SEQ ID NO: 5207 - DNA, 25 bp, Homo sapiens
tcctccgggccttcggctctgtgtc

SEQ ID NO: 5208 - DNA, 25 bp, Homo sapiens
cctccgggccttcggctctgtgtcc

SEQ ID NO: 5209 - DNA, 25 bp, Homo sapiens
ctccgggccttcggctctgtgtcca

SEQ ID NO: 5210 - DNA, 25 bp, Homo sapiens
tccgggccttcggctctgtgtccat

SEQ ID NO: 5211 - DNA, 25 bp, Homo sapiens
ccgggccttcggctctgtgtccatg

SEQ ID NO: 5212 - DNA, 25 bp, Homo sapiens
cgggccttcggctctgtgtccatgg

SEQ ID NO: 5213 - DNA, 25 bp, Homo sapiens
gggccttcggctctgtgtccatggc

SEQ ID NO: 5214 - DNA, 25 bp, Homo sapiens
ggccttcggctctgtgtccatggcc

SEQ ID NO: 5215 - DNA, 25 bp, Homo sapiens
gccttcggctctgtgtccatggccc

SEQ ID NO: 5216 - DNA, 25 bp, Homo sapiens
ccttcggctctgtgtccatggccca

SEQ ID NO: 5217 - DNA, 25 bp, Homo sapiens
cttcggctctgtgtccatggcccac

SEQ ID NO: 5218 - DNA, 25 bp, Homo sapiens
ttcggctctgtgtccatggcccaca

SEQ ID NO: 5219 - DNA, 25 bp, Homo sapiens
tcggctctgtgtccatggcccacag

SEQ ID NO: 5220 - DNA, 25 bp, Homo sapiens
cggctctgtgtccatggcccacagc

SEQ ID NO: 5221 - DNA, 25 bp, Homo sapiens
ggctctgtgtccatggcccacagcc

SEQ ID NO: 5222 - DNA, 25 bp, Homo sapiens
gctctgtgtccatggcccacagccg

SEQ ID NO: 5223 - DNA, 25 bp, Homo sapiens
ctctgtgtccatggcccacagccgc

SEQ ID NO: 5224 - DNA, 25 bp, Homo sapiens
tctgtgtccatggcccacagccgca

SEQ ID NO: 5225 - DNA, 25 bp, Homo sapiens
ctgtgtccatggcccacagccgcag

SEQ ID NO: 5226 - DNA, 25 bp, Homo sapiens
tgtgtccatggcccacagccgcagt

SEQ ID NO: 5227 - DNA, 25 bp, Homo sapiens
gtgtccatggcccacagccgcagtg

SEQ ID NO: 5228 - DNA, 25 bp, Homo sapiens
tgtccatggcccacagccgcagtgc

SEQ ID NO: 5229 - DNA, 25 bp, Homo sapiens
gtccatggcccacagccgcagtgcc

SEQ ID NO: 5230 - DNA, 25 bp, Homo sapiens
tccatggcccacagccgcagtgcca

SEQ ID NO: 5231 - DNA, 25 bp, Homo sapiens
ccatggcccacagccgcagtgccac

SEQ ID NO: 5232 - DNA, 25 bp, Homo sapiens
catggcccacagccgcagtgccacc

SEQ ID NO: 5233 - DNA, 25 bp, Homo sapiens
atggcccacagccgcagtgccaccc

SEQ ID NO: 5234 - DNA, 25 bp, Homo sapiens
tggcccacagccgcagtgccacccg

SEQ ID NO: 5235 - DNA, 25 bp, Homo sapiens
ggcccacagccgcagtgccacccgg

SEQ ID NO: 5236 - DNA, 25 bp, Homo sapiens
gcccacagccgcagtgccacccggt

SEQ ID NO: 5237 - DNA, 25 bp, Homo sapiens
cccacagccgcagtgccacccggtt

SEQ ID NO: 5238 - DNA, 25 bp, Homo sapiens
ccacagccgcagtgccacccggttc

SEQ ID NO: 5239 - DNA, 25 bp, Homo sapiens
cacagccgcagtgccacccggttct

SEQ ID NO: 5240 - DNA, 25 bp, Homo sapiens
acagccgcagtgccacccggttctc

SEQ ID NO: 5241 - DNA, 25 bp, Homo sapiens
cagccgcagtgccacccggttctcc

SEQ ID NO: 5242 - DNA, 25 bp, Homo sapiens
agccgcagtgccacccggttctcca

SEQ ID NO: 5243 - DNA, 25 bp, Homo sapiens
gccgcagtgccacccggttctccat

SEQ ID NO: 5244 - DNA, 25 bp, Homo sapiens
ccgcagtgccacccggttctccatg

SEQ ID NO: 5245 - DNA, 25 bp, Homo sapiens
cgcagtgccacccggttctccatgg

SEQ ID NO: 5246 - DNA, 25 bp, Homo sapiens
gcagtgccacccggttctccatggt

SEQ ID NO: 5247 - DNA, 25 bp, Homo sapiens
cagtgccacccggttctccatggtg

SEQ ID NO: 5248 - DNA, 25 bp, Homo sapiens
agtgccacccggttctccatggtga

SEQ ID NO: 5249 - DNA, 25 bp, Homo sapiens
gtgccacccggttctccatggtgat

SEQ ID NO: 5250 - DNA, 25 bp, Homo sapiens
tgccacccggttctccatggtgatg

SEQ ID NO: 5251 - DNA, 25 bp, Homo sapiens
gccacccggttctccatggtgatgt

SEQ ID NO: 5252 - DNA, 25 bp, Homo sapiens
ccacccggttctccatggtgatgtc

SEQ ID NO: 5253 - DNA, 25 bp, Homo sapiens
cacccggttctccatggtgatgtcg

SEQ ID NO: 5254 - DNA, 25 bp, Homo sapiens
acccggttctccatggtgatgtcgc

SEQ ID NO: 5255 - DNA, 25 bp, Homo sapiens
cccggttctccatggtgatgtcgct

SEQ ID NO: 5256 - DNA, 25 bp, Homo sapiens
ccggttctccatggtgatgtcgctg

SEQ ID NO: 5257 - DNA, 25 bp, Homo sapiens
cggttctccatggtgatgtcgctgg

SEQ ID NO: 5258 - DNA, 25 bp, Homo sapiens
ggttctccatggtgatgtcgctgga

SEQ ID NO: 5259 - DNA, 25 bp, Homo sapiens
gttctccatggtgatgtcgctggac

SEQ ID NO: 5260 - DNA, 25 bp, Homo sapiens
ttctccatggtgatgtcgctggact

SEQ ID NO: 5261 - DNA, 25 bp, Homo sapiens
tctccatggtgatgtcgctggactt

SEQ ID NO: 5262 - DNA, 25 bp, Homo sapiens
ctccatggtgatgtcgctggacttc

SEQ ID NO: 5263 - DNA, 25 bp, Homo sapiens
tccatggtgatgtcgctggacttca

SEQ ID NO: 5264 - DNA, 25 bp, Homo sapiens
ccatggtgatgtcgctggacttcaa

SEQ ID NO: 5265 - DNA, 25 bp, Homo sapiens
catggtgatgtcgctggacttcaac

SEQ ID NO: 5266 - DNA, 25 bp, Homo sapiens
atggtgatgtcgctggacttcaacg

SEQ ID NO: 5267 - DNA, 25 bp, Homo sapiens
tggtgatgtcgctggacttcaacgc

SEQ ID NO: 5268 - DNA, 25 bp, Homo sapiens
ggtgatgtcgctggacttcaacgct

SEQ ID NO: 5269 - DNA, 25 bp, Homo sapiens
gtgatgtcgctggacttcaacgcta

SEQ ID NO: 5270 - DNA, 25 bp, Homo sapiens
tgatgtcgctggacttcaacgctac

SEQ ID NO: 5271 - DNA, 25 bp, Homo sapiens
gatgtcgctggacttcaacgctaca

SEQ ID NO: 5272 - DNA, 25 bp, Homo sapiens
atgtcgctggacttcaacgctacag

SEQ ID NO: 5273 - DNA, 25 bp, Homo sapiens
tgtcgctggacttcaacgctacagg

SEQ ID NO: 5274 - DNA, 25 bp, Homo sapiens
gtcgctggacttcaacgctacaggc

SEQ ID NO: 5275 - DNA, 25 bp, Homo sapiens
tcgctggacttcaacgctacaggcc

SEQ ID NO: 5276 - DNA, 25 bp, Homo sapiens
cgctggacttcaacgctacaggccg

SEQ ID NO: 5277 - DNA, 25 bp, Homo sapiens
gctggacttcaacgctacaggccgc

SEQ ID NO: 5278 - DNA, 25 bp, Homo sapiens
ctggacttcaacgctacaggccgca

SEQ ID NO: 5279 - DNA, 25 bp, Homo sapiens
tggacttcaacgctacaggccgcat

SEQ ID NO: 5280 - DNA, 25 bp, Homo sapiens
ggacttcaacgctacaggccgcatc

SEQ ID NO: 5281 - DNA, 25 bp, Homo sapiens
gacttcaacgctacaggccgcatca

SEQ ID NO: 5282 - DNA, 25 bp, Homo sapiens
acttcaacgctacaggccgcatcac

SEQ ID NO: 5283 - DNA, 25 bp, Homo sapiens
cttcaacgctacaggccgcatcaca

SEQ ID NO: 5284 - DNA, 25 bp, Homo sapiens
ttcaacgctacaggccgcatcacag

SEQ ID NO: 5285 - DNA, 25 bp, Homo sapiens
tcaacgctacaggccgcatcacagc

SEQ ID NO: 5286 - DNA, 25 bp, Homo sapiens
caacgctacaggccgcatcacagct

SEQ ID NO: 5287 - DNA, 25 bp, Homo sapiens
aacgctacaggccgcatcacagctg

SEQ ID NO: 5288 - DNA, 25 bp, Homo sapiens
acgctacaggccgcatcacagctgc

SEQ ID NO: 5289 - DNA, 25 bp, Homo sapiens
cgctacaggccgcatcacagctgct

SEQ ID NO: 5290 - DNA, 25 bp, Homo sapiens
gctacaggccgcatcacagctgctc

SEQ ID NO: 5291 - DNA, 25 bp, Homo sapiens
ctacaggccgcatcacagctgctca

SEQ ID NO: 5292 - DNA, 25 bp, Homo sapiens
tacaggccgcatcacagctgctcag

SEQ ID NO: 5293 - DNA, 25 bp, Homo sapiens
acaggccgcatcacagctgctcagc

SEQ ID NO: 5294 - DNA, 25 bp, Homo sapiens
caggccgcatcacagctgctcagct

SEQ ID NO: 5295 - DNA, 25 bp, Homo sapiens
aggccgcatcacagctgctcagctc

SEQ ID NO: 5296 - DNA, 25 bp, Homo sapiens
ggccgcatcacagctgctcagctcc

SEQ ID NO: 5297 - DNA, 25 bp, Homo sapiens
gccgcatcacagctgctcagctcca

SEQ ID NO: 5298 - DNA, 25 bp, Homo sapiens
ccgcatcacagctgctcagctccag

SEQ ID NO: 5299 - DNA, 25 bp, Homo sapiens
cgcatcacagctgctcagctccaga

SEQ ID NO: 5300 - DNA, 25 bp, Homo sapiens
gcatcacagctgctcagctccagac

SEQ ID NO: 5301 - DNA, 25 bp, Homo sapiens
catcacagctgctcagctccagaca

SEQ ID NO: 5302 - DNA, 25 bp, Homo sapiens
atcacagctgctcagctccagacaa

SEQ ID NO: 5303 - DNA, 25 bp, Homo sapiens
tcacagctgctcagctccagacaat

SEQ ID NO: 5304 - DNA, 25 bp, Homo sapiens
cacagctgctcagctccagacaatg

SEQ ID NO: 5305 - DNA, 25 bp, Homo sapiens
acagctgctcagctccagacaatgc

SEQ ID NO: 5306 - DNA, 25 bp, Homo sapiens
cagctgctcagctccagacaatgct

SEQ ID NO: 5307 - DNA, 25 bp, Homo sapiens
agctgctcagctccagacaatgctt

SEQ ID NO: 5308 - DNA, 25 bp, Homo sapiens
gctgctcagctccagacaatgcttt

SEQ ID NO: 5309 - DNA, 25 bp, Homo sapiens
ctgctcagctccagacaatgctttt

SEQ ID NO: 5310 - DNA, 25 bp, Homo sapiens
tgctcagctccagacaatgcttttg

SEQ ID NO: 5311 - DNA, 25 bp, Homo sapiens
gctcagctccagacaatgcttttgg

SEQ ID NO: 5312 - DNA, 25 bp, Homo sapiens
ctcagctccagacaatgcttttgga

SEQ ID NO: 5313 - DNA, 25 bp, Homo sapiens
tcagctccagacaatgcttttggag

SEQ ID NO: 5314 - DNA, 25 bp, Homo sapiens
cagctccagacaatgcttttggaga

SEQ ID NO: 5315 - DNA, 25 bp, Homo sapiens
agctccagacaatgcttttggagaa

SEQ ID NO: 5316 - DNA, 25 bp, Homo sapiens
gctccagacaatgcttttggagaag

SEQ ID NO: 5317 - DNA, 25 bp, Homo sapiens
ctccagacaatgcttttggagaaga

SEQ ID NO: 5318 - DNA, 25 bp, Homo sapiens
tccagacaatgcttttggagaagag

SEQ ID NO: 5319 - DNA, 25 bp, Homo sapiens
ccagacaatgcttttggagaagagc

SEQ ID NO: 5320 - DNA, 25 bp, Homo sapiens
cagacaatgcttttggagaagagcc

SEQ ID NO: 5321 - DNA, 25 bp, Homo sapiens
agacaatgcttttggagaagagccg

SEQ ID NO: 5322 - DNA, 25 bp, Homo sapiens
gacaatgcttttggagaagagccgc

SEQ ID NO: 5323 - DNA, 25 bp, Homo sapiens
acaatgcttttggagaagagccgcg

SEQ ID NO: 5324 - DNA, 25 bp, Homo sapiens
caatgcttttggagaagagccgcgt

SEQ ID NO: 5325 - DNA, 25 bp, Homo sapiens
aatgcttttggagaagagccgcgtg

SEQ ID NO: 5326 - DNA, 25 bp, Homo sapiens
atgcttttggagaagagccgcgtgg

SEQ ID NO: 5327 - DNA, 25 bp, Homo sapiens
tgcttttggagaagagccgcgtggc

SEQ ID NO: 5328 - DNA, 25 bp, Homo sapiens
gcttttggagaagagccgcgtggca

SEQ ID NO: 5329 - DNA, 25 bp, Homo sapiens
cttttggagaagagccgcgtggcac

SEQ ID NO: 5330 - DNA, 25 bp, Homo sapiens
ttttggagaagagccgcgtggcacg

SEQ ID NO: 5331 - DNA, 25 bp, Homo sapiens
tttggagaagagccgcgtggcacgg

SEQ ID NO: 5332 - DNA, 25 bp, Homo sapiens
ttggagaagagccgcgtggcacggc

SEQ ID NO: 5333 - DNA, 25 bp, Homo sapiens
tggagaagagccgcgtggcacggca

SEQ ID NO: 5334 - DNA, 25 bp, Homo sapiens
ggagaagagccgcgtggcacggcag

SEQ ID NO: 5335 - DNA, 25 bp, Homo sapiens
gagaagagccgcgtggcacggcagc

SEQ ID NO: 5336 - DNA, 25 bp, Homo sapiens
agaagagccgcgtggcacggcagcc

SEQ ID NO: 5337 - DNA, 25 bp, Homo sapiens
gaagagccgcgtggcacggcagccg

SEQ ID NO: 5338 - DNA, 25 bp, Homo sapiens
aagagccgcgtggcacggcagccgg

SEQ ID NO: 5339 - DNA, 25 bp, Homo sapiens
agagccgcgtggcacggcagccgga

SEQ ID NO: 5340 - DNA, 25 bp, Homo sapiens
gagccgcgtggcacggcagccggaa

SEQ ID NO: 5341 - DNA, 25 bp, Homo sapiens
agccgcgtggcacggcagccggaag

SEQ ID NO: 5342 - DNA, 25 bp, Homo sapiens
gccgcgtggcacggcagccggaagg

SEQ ID NO: 5343 - DNA, 25 bp, Homo sapiens
ccgcgtggcacggcagccggaaggg

SEQ ID NO: 5344 - DNA, 25 bp, Homo sapiens
cgcgtggcacggcagccggaagggg

SEQ ID NO: 5345 - DNA, 25 bp, Homo sapiens
gcgtggcacggcagccggaagggga

SEQ ID NO: 5346 - DNA, 25 bp, Homo sapiens
cgtggcacggcagccggaaggggaa

SEQ ID NO: 5347 - DNA, 25 bp, Homo sapiens
gtggcacggcagccggaaggggaaa

SEQ ID NO: 5348 - DNA, 25 bp, Homo sapiens
tggcacggcagccggaaggggaaag

SEQ ID NO: 5349 - DNA, 25 bp, Homo sapiens
ggcacggcagccggaaggggaaagt

SEQ ID NO: 5350 - DNA, 25 bp, Homo sapiens
gcacggcagccggaaggggaaagta

SEQ ID NO: 5351 - DNA, 25 bp, Homo sapiens
cacggcagccggaaggggaaagtaa

SEQ ID NO: 5352 - DNA, 25 bp, Homo sapiens
acggcagccggaaggggaaagtaac

SEQ ID NO: 5353 - DNA, 25 bp, Homo sapiens
cggcagccggaaggggaaagtaact

SEQ ID NO: 5354 - DNA, 25 bp, Homo sapiens
ggcagccggaaggggaaagtaactt

SEQ ID NO: 5355 - DNA, 25 bp, Homo sapiens
gcagccggaaggggaaagtaacttc

SEQ ID NO: 5356 - DNA, 25 bp, Homo sapiens
cagccggaaggggaaagtaacttcc

SEQ ID NO: 5357 - DNA, 25 bp, Homo sapiens
agccggaaggggaaagtaacttcct

SEQ ID NO: 5358 - DNA, 25 bp, Homo sapiens
gccggaaggggaaagtaacttcctg

SEQ ID NO: 5359 - DNA, 25 bp, Homo sapiens
ccggaaggggaaagtaacttcctgg

SEQ ID NO: 5360 - DNA, 25 bp, Homo sapiens
cggaaggggaaagtaacttcctggt

SEQ ID NO: 5361 - DNA, 25 bp, Homo sapiens
ggaaggggaaagtaacttcctggtt

SEQ ID NO: 5362 - DNA, 25 bp, Homo sapiens
gaaggggaaagtaacttcctggttt

SEQ ID NO: 5363 - DNA, 25 bp, Homo sapiens
aaggggaaagtaacttcctggtttt

SEQ ID NO: 5364 - DNA, 25 bp, Homo sapiens
aggggaaagtaacttcctggttttc

SEQ ID NO: 5365 - DNA, 25 bp, Homo sapiens
ggggaaagtaacttcctggttttct

SEQ ID NO: 5366 - DNA, 25 bp, Homo sapiens
gggaaagtaacttcctggttttctc

SEQ ID NO: 5367 - DNA, 25 bp, Homo sapiens
ggaaagtaacttcctggttttctcc

SEQ ID NO: 5368 - DNA, 25 bp, Homo sapiens
gaaagtaacttcctggttttctccc

SEQ ID NO: 5369 - DNA, 25 bp, Homo sapiens
aaagtaacttcctggttttctccca

SEQ ID NO: 5370 - DNA, 25 bp, Homo sapiens
aagtaacttcctggttttctcccag

SEQ ID NO: 5371 - DNA, 25 bp, Homo sapiens
agtaacttcctggttttctcccaga

SEQ ID NO: 5372 - DNA, 25 bp, Homo sapiens
gtaacttcctggttttctcccagat

SEQ ID NO: 5373 - DNA, 25 bp, Homo sapiens
taacttcctggttttctcccagatg

SEQ ID NO: 5374 - DNA, 25 bp, Homo sapiens
aacttcctggttttctcccagatgc

SEQ ID NO: 5375 - DNA, 25 bp, Homo sapiens
acttcctggttttctcccagatgct

SEQ ID NO: 5376 - DNA, 25 bp, Homo sapiens
cttcctggttttctcccagatgctg

SEQ ID NO: 5377 - DNA, 25 bp, Homo sapiens
ttcctggttttctcccagatgctgg

SEQ ID NO: 5378 - DNA, 25 bp, Homo sapiens
tcctggttttctcccagatgctggc

SEQ ID NO: 5379 - DNA, 25 bp, Homo sapiens
cctggttttctcccagatgctggct

SEQ ID NO: 5380 - DNA, 25 bp, Homo sapiens
ctggttttctcccagatgctggctg

SEQ ID NO: 5381 - DNA, 25 bp, Homo sapiens
tggttttctcccagatgctggctgg

SEQ ID NO: 5382 - DNA, 25 bp, Homo sapiens
ggttttctcccagatgctggctgga

SEQ ID NO: 5383 - DNA, 25 bp, Homo sapiens
gttttctcccagatgctggctggat

SEQ ID NO: 5384 - DNA, 25 bp, Homo sapiens
ttttctcccagatgctggctggatt

SEQ ID NO: 5385 - DNA, 25 bp, Homo sapiens
tttctcccagatgctggctggattg

SEQ ID NO: 5386 - DNA, 25 bp, Homo sapiens
ttctcccagatgctggctggattgg

SEQ ID NO: 5387 - DNA, 25 bp, Homo sapiens
tctcccagatgctggctggattgga

SEQ ID NO: 5388 - DNA, 25 bp, Homo sapiens
ctcccagatgctggctggattggac

SEQ ID NO: 5389 - DNA, 25 bp, Homo sapiens
tcccagatgctggctggattggact

SEQ ID NO: 5390 - DNA, 25 bp, Homo sapiens
cccagatgctggctggattggactt

SEQ ID NO: 5391 - DNA, 25 bp, Homo sapiens
ccagatgctggctggattggacttg

SEQ ID NO: 5392 - DNA, 25 bp, Homo sapiens
cagatgctggctggattggacttgg

SEQ ID NO: 5393 - DNA, 25 bp, Homo sapiens
agatgctggctggattggacttgga

SEQ ID NO: 5394 - DNA, 25 bp, Homo sapiens
gatgctggctggattggacttggat

SEQ ID NO: 5395 - DNA, 25 bp, Homo sapiens
atgctggctggattggacttggatc

SEQ ID NO: 5396 - DNA, 25 bp, Homo sapiens
tgctggctggattggacttggatct

SEQ ID NO: 5397 - DNA, 25 bp, Homo sapiens
gctggctggattggacttggatctc

SEQ ID NO: 5398 - DNA, 25 bp, Homo sapiens
ctggctggattggacttggatctca

SEQ ID NO: 5399 - DNA, 25 bp, Homo sapiens
tggctggattggacttggatctcag

SEQ ID NO: 5400 - DNA, 25 bp, Homo sapiens
ggctggattggacttggatctcagg

SEQ ID NO: 5401 - DNA, 25 bp, Homo sapiens
gctggattggacttggatctcagga

SEQ ID NO: 5402 - DNA, 25 bp, Homo sapiens
ctggattggacttggatctcaggac

SEQ ID NO: 5403 - DNA, 25 bp, Homo sapiens
tggattggacttggatctcaggacg

SEQ ID NO: 5404 - DNA, 25 bp, Homo sapiens
ggattggacttggatctcaggacgg

SEQ ID NO: 5405 - DNA, 25 bp, Homo sapiens
gattggacttggatctcaggacgga

SEQ ID NO: 5406 - DNA, 25 bp, Homo sapiens
attggacttggatctcaggacggag

SEQ ID NO: 5407 - DNA, 25 bp, Homo sapiens
ttggacttggatctcaggacggagc

SEQ ID NO: 5408 - DNA, 25 bp, Homo sapiens
tggacttggatctcaggacggagct

SEQ ID NO: 5409 - DNA, 25 bp, Homo sapiens
ggacttggatctcaggacggagctg

SEQ ID NO: 5410 - DNA, 25 bp, Homo sapiens
gacttggatctcaggacggagctga

SEQ ID NO: 5411 - DNA, 25 bp, Homo sapiens
acttggatctcaggacggagctgaa

SEQ ID NO: 5412 - DNA, 25 bp, Homo sapiens
cttggatctcaggacggagctgaac

SEQ ID NO: 5413 - DNA, 25 bp, Homo sapiens
ttggatctcaggacggagctgaacc

SEQ ID NO: 5414 - DNA, 25 bp, Homo sapiens
tggatctcaggacggagctgaacct

SEQ ID NO: 5415 - DNA, 25 bp, Homo sapiens
ggatctcaggacggagctgaacctg

SEQ ID NO: 5416 - DNA, 25 bp, Homo sapiens
gatctcaggacggagctgaacctgc

SEQ ID NO: 5417 - DNA, 25 bp, Homo sapiens
atctcaggacggagctgaacctgca

SEQ ID NO: 5418 - DNA, 25 bp, Homo sapiens
tctcaggacggagctgaacctgcac

SEQ ID NO: 5419 - DNA, 25 bp, Homo sapiens
ctcaggacggagctgaacctgcacc

SEQ ID NO: 5420 - DNA, 25 bp, Homo sapiens
tcaggacggagctgaacctgcacca

SEQ ID NO: 5421 - DNA, 25 bp, Homo sapiens
caggacggagctgaacctgcaccag

SEQ ID NO: 5422 - DNA, 25 bp, Homo sapiens
aggacggagctgaacctgcaccaga

SEQ ID NO: 5423 - DNA, 25 bp, Homo sapiens
ggacggagctgaacctgcaccagat

SEQ ID NO: 5424 - DNA, 25 bp, Homo sapiens
gacggagctgaacctgcaccagatg

SEQ ID NO: 5425 - DNA, 25 bp, Homo sapiens
acggagctgaacctgcaccagatgg

SEQ ID NO: 5426 - DNA, 25 bp, Homo sapiens
cggagctgaacctgcaccagatggc

SEQ ID NO: 5427 - DNA, 25 bp, Homo sapiens
ggagctgaacctgcaccagatggca

SEQ ID NO: 5428 - DNA, 25 bp, Homo sapiens
gagctgaacctgcaccagatggcag

SEQ ID NO: 5429 - DNA, 25 bp, Homo sapiens
agctgaacctgcaccagatggcaga

SEQ ID NO: 5430 - DNA, 25 bp, Homo sapiens
gctgaacctgcaccagatggcagat

SEQ ID NO: 5431 - DNA, 25 bp, Homo sapiens
ctgaacctgcaccagatggcagata

SEQ ID NO: 5432 - DNA, 25 bp, Homo sapiens
tgaacctgcaccagatggcagatag

SEQ ID NO: 5433 - DNA, 25 bp, Homo sapiens
gaacctgcaccagatggcagatagc

SEQ ID NO: 5434 - DNA, 25 bp, Homo sapiens
aacctgcaccagatggcagatagca

SEQ ID NO: 5435 - DNA, 25 bp, Homo sapiens
acctgcaccagatggcagatagcag

SEQ ID NO: 5436 - DNA, 25 bp, Homo sapiens
cctgcaccagatggcagatagcagc

SEQ ID NO: 5437 - DNA, 25 bp, Homo sapiens
ctgcaccagatggcagatagcagct

SEQ ID NO: 5438 - DNA, 25 bp, Homo sapiens
tgcaccagatggcagatagcagctc

SEQ ID NO: 5439 - DNA, 25 bp, Homo sapiens
gcaccagatggcagatagcagctcc

SEQ ID NO: 5440 - DNA, 25 bp, Homo sapiens
caccagatggcagatagcagctcct

SEQ ID NO: 5441 - DNA, 25 bp, Homo sapiens
accagatggcagatagcagctcctt

SEQ ID NO: 5442 - DNA, 25 bp, Homo sapiens
ccagatggcagatagcagctccttt

SEQ ID NO: 5443 - DNA, 25 bp, Homo sapiens
cagatggcagatagcagctcctttg

SEQ ID NO: 5444 - DNA, 25 bp, Homo sapiens
agatggcagatagcagctcctttgg

SEQ ID NO: 5445 - DNA, 25 bp, Homo sapiens
gatggcagatagcagctcctttggc

SEQ ID NO: 5446 - DNA, 25 bp, Homo sapiens
atggcagatagcagctcctttggca

SEQ ID NO: 5447 - DNA, 25 bp, Homo sapiens
tggcagatagcagctcctttggcat

SEQ ID NO: 5448 - DNA, 25 bp, Homo sapiens
ggcagatagcagctcctttggcatg

SEQ ID NO: 5449 - DNA, 25 bp, Homo sapiens
gcagatagcagctcctttggcatgg

SEQ ID NO: 5450 - DNA, 25 bp, Homo sapiens
cagatagcagctcctttggcatggg

SEQ ID NO: 5451 - DNA, 25 bp, Homo sapiens
agatagcagctcctttggcatgggc

SEQ ID NO: 5452 - DNA, 25 bp, Homo sapiens
gatagcagctcctttggcatgggcg

SEQ ID NO: 5453 - DNA, 25 bp, Homo sapiens
atagcagctcctttggcatgggcgt

SEQ ID NO: 5454 - DNA, 25 bp, Homo sapiens
tagcagctcctttggcatgggcgtg

SEQ ID NO: 5455 - DNA, 25 bp, Homo sapiens
agcagctcctttggcatgggcgtgt

SEQ ID NO: 5456 - DNA, 25 bp, Homo sapiens
gcagctcctttggcatgggcgtgtg

SEQ ID NO: 5457 - DNA, 25 bp, Homo sapiens
cagctcctttggcatgggcgtgtgg

SEQ ID NO: 5458 - DNA, 25 bp, Homo sapiens
agctcctttggcatgggcgtgtggt

SEQ ID NO: 5459 - DNA, 25 bp, Homo sapiens
gctcctttggcatgggcgtgtggtc

SEQ ID NO: 5460 - DNA, 25 bp, Homo sapiens
ctcctttggcatgggcgtgtggtcc

SEQ ID NO: 5461 - DNA, 25 bp, Homo sapiens
tcctttggcatgggcgtgtggtcca

SEQ ID NO: 5462 - DNA, 25 bp, Homo sapiens
cctttggcatgggcgtgtggtccaa

SEQ ID NO: 5463 - DNA, 25 bp, Homo sapiens
ctttggcatgggcgtgtggtccaag

SEQ ID NO: 5464 - DNA, 25 bp, Homo sapiens
tttggcatgggcgtgtggtccaagc

SEQ ID NO: 5465 - DNA, 25 bp, Homo sapiens
ttggcatgggcgtgtggtccaagcc

SEQ ID NO: 5466 - DNA, 25 bp, Homo sapiens
tggcatgggcgtgtggtccaagcct

SEQ ID NO: 5467 - DNA, 25 bp, Homo sapiens
ggcatgggcgtgtggtccaagcctg

SEQ ID NO: 5468 - DNA, 25 bp, Homo sapiens
gcatgggcgtgtggtccaagcctga

SEQ ID NO: 5469 - DNA, 25 bp, Homo sapiens
catgggcgtgtggtccaagcctgaa

SEQ ID NO: 5470 - DNA, 25 bp, Homo sapiens
atgggcgtgtggtccaagcctgaag

SEQ ID NO: 5471 - DNA, 25 bp, Homo sapiens
tgggcgtgtggtccaagcctgaaga

SEQ ID NO: 5472 - DNA, 25 bp, Homo sapiens
gggcgtgtggtccaagcctgaagat

SEQ ID NO: 5473 - DNA, 25 bp, Homo sapiens
ggcgtgtggtccaagcctgaagata

SEQ ID NO: 5474 - DNA, 25 bp, Homo sapiens
gcgtgtggtccaagcctgaagataa

SEQ ID NO: 5475 - DNA, 25 bp, Homo sapiens
cgtgtggtccaagcctgaagataaa

SEQ ID NO: 5476 - DNA, 25 bp, Homo sapiens
gtgtggtccaagcctgaagataaac

SEQ ID NO: 5477 - DNA, 25 bp, Homo sapiens
tgtggtccaagcctgaagataaaca

SEQ ID NO: 5478 - DNA, 25 bp, Homo sapiens
gtggtccaagcctgaagataaacag

SEQ ID NO: 5479 - DNA, 25 bp, Homo sapiens
tggtccaagcctgaagataaacaga

SEQ ID NO: 5480 - DNA, 25 bp, Homo sapiens
ggtccaagcctgaagataaacagaa

SEQ ID NO: 5481 - DNA, 25 bp, Homo sapiens
gtccaagcctgaagataaacagaag

SEQ ID NO: 5482 - DNA, 25 bp, Homo sapiens
tccaagcctgaagataaacagaagg

SEQ ID NO: 5483 - DNA, 25 bp, Homo sapiens
ccaagcctgaagataaacagaaggc

SEQ ID NO: 5484 - DNA, 25 bp, Homo sapiens
caagcctgaagataaacagaaggcg

SEQ ID NO: 5485 - DNA, 25 bp, Homo sapiens
aagcctgaagataaacagaaggcgg

SEQ ID NO: 5486 - DNA, 25 bp, Homo sapiens
agcctgaagataaacagaaggcggc

SEQ ID NO: 5487 - DNA, 25 bp, Homo sapiens
gcctgaagataaacagaaggcggca

SEQ ID NO: 5488 - DNA, 25 bp, Homo sapiens
cctgaagataaacagaaggcggcag

SEQ ID NO: 5489 - DNA, 25 bp, Homo sapiens
ctgaagataaacagaaggcggcagc

SEQ ID NO: 5490 - DNA, 25 bp, Homo sapiens
tgaagataaacagaaggcggcagct

SEQ ID NO: 5491 - DNA, 25 bp, Homo sapiens
gaagataaacagaaggcggcagctg

SEQ ID NO: 5492 - DNA, 25 bp, Homo sapiens
aagataaacagaaggcggcagctgc

SEQ ID NO: 5493 - DNA, 25 bp, Homo sapiens
agataaacagaaggcggcagctgcc

SEQ ID NO: 5494 - DNA, 25 bp, Homo sapiens
gataaacagaaggcggcagctgcct

SEQ ID NO: 5495 - DNA, 25 bp, Homo sapiens
ataaacagaaggcggcagctgcctt

SEQ ID NO: 5496 - DNA, 25 bp, Homo sapiens
taaacagaaggcggcagctgccttt

SEQ ID NO: 5497 - DNA, 25 bp, Homo sapiens
aaacagaaggcggcagctgcctttg

SEQ ID NO: 5498 - DNA, 25 bp, Homo sapiens
aacagaaggcggcagctgcctttgc

SEQ ID NO: 5499 - DNA, 25 bp, Homo sapiens
acagaaggcggcagctgcctttgcc

SEQ ID NO: 5500 - DNA, 25 bp, Homo sapiens
cagaaggcggcagctgcctttgccc

SEQ ID NO: 5501 - DNA, 25 bp, Homo sapiens
agaaggcggcagctgcctttgccca

SEQ ID NO: 5502 - DNA, 25 bp, Homo sapiens
gaaggcggcagctgcctttgcccag

SEQ ID NO: 5503 - DNA, 25 bp, Homo sapiens
aaggcggcagctgcctttgcccagc

SEQ ID NO: 5504 - DNA, 25 bp, Homo sapiens
aggcggcagctgcctttgcccagct

SEQ ID NO: 5505 - DNA, 25 bp, Homo sapiens
ggcggcagctgcctttgcccagctc

SEQ ID NO: 5506 - DNA, 25 bp, Homo sapiens
gcggcagctgcctttgcccagctcc

SEQ ID NO: 5507 - DNA, 25 bp, Homo sapiens
cggcagctgcctttgcccagctcca

SEQ ID NO: 5508 - DNA, 25 bp, Homo sapiens
ggcagctgcctttgcccagctccag

SEQ ID NO: 5509 - DNA, 25 bp, Homo sapiens
gcagctgcctttgcccagctccagg

SEQ ID NO: 5510 - DNA, 25 bp, Homo sapiens
cagctgcctttgcccagctccaggg

SEQ ID NO: 5511 - DNA, 25 bp, Homo sapiens
agctgcctttgcccagctccagggt

SEQ ID NO: 5512 - DNA, 25 bp, Homo sapiens
gctgcctttgcccagctccagggtg

SEQ ID NO: 5513 - DNA, 25 bp, Homo sapiens
ctgcctttgcccagctccagggtgc

SEQ ID NO: 5514 - DNA, 25 bp, Homo sapiens
tgcctttgcccagctccagggtgcc

SEQ ID NO: 5515 - DNA, 25 bp, Homo sapiens
gcctttgcccagctccagggtgcca

SEQ ID NO: 5516 - DNA, 25 bp, Homo sapiens
cctttgcccagctccagggtgccat

SEQ ID NO: 5517 - DNA, 25 bp, Homo sapiens
ctttgcccagctccagggtgccatg

SEQ ID NO: 5518 - DNA, 25 bp, Homo sapiens
tttgcccagctccagggtgccatgg

SEQ ID NO: 5519 - DNA, 25 bp, Homo sapiens
ttgcccagctccagggtgccatgga

SEQ ID NO: 5520 - DNA, 25 bp, Homo sapiens
tgcccagctccagggtgccatggag

SEQ ID NO: 5521 - DNA, 25 bp, Homo sapiens
gcccagctccagggtgccatggaga

SEQ ID NO: 5522 - DNA, 25 bp, Homo sapiens
cccagctccagggtgccatggagat

SEQ ID NO: 5523 - DNA, 25 bp, Homo sapiens
ccagctccagggtgccatggagatg

SEQ ID NO: 5524 - DNA, 25 bp, Homo sapiens
cagctccagggtgccatggagatgc

SEQ ID NO: 5525 - DNA, 25 bp, Homo sapiens
agctccagggtgccatggagatgct

SEQ ID NO: 5526 - DNA, 25 bp, Homo sapiens
gctccagggtgccatggagatgctg

SEQ ID NO: 5527 - DNA, 25 bp, Homo sapiens
ctccagggtgccatggagatgctgg

SEQ ID NO: 5528 - DNA, 25 bp, Homo sapiens
tccagggtgccatggagatgctggg

SEQ ID NO: 5529 - DNA, 25 bp, Homo sapiens
ccagggtgccatggagatgctgggc

SEQ ID NO: 5530 - DNA, 25 bp, Homo sapiens
cagggtgccatggagatgctgggca

SEQ ID NO: 5531 - DNA, 25 bp, Homo sapiens
agggtgccatggagatgctgggcat

SEQ ID NO: 5532 - DNA, 25 bp, Homo sapiens
gggtgccatggagatgctgggcatc

SEQ ID NO: 5533 - DNA, 25 bp, Homo sapiens
ggtgccatggagatgctgggcatct

SEQ ID NO: 5534 - DNA, 25 bp, Homo sapiens
gtgccatggagatgctgggcatctc

SEQ ID NO: 5535 - DNA, 25 bp, Homo sapiens
tgccatggagatgctgggcatctca

SEQ ID NO: 5536 - DNA, 25 bp, Homo sapiens
gccatggagatgctgggcatctcag

SEQ ID NO: 5537 - DNA, 25 bp, Homo sapiens
ccatggagatgctgggcatctcaga

SEQ ID NO: 5538 - DNA, 25 bp, Homo sapiens
catggagatgctgggcatctcagag

SEQ ID NO: 5539 - DNA, 25 bp, Homo sapiens
atggagatgctgggcatctcagaga

SEQ ID NO: 5540 - DNA, 25 bp, Homo sapiens
tggagatgctgggcatctcagagag

SEQ ID NO: 5541 - DNA, 25 bp, Homo sapiens
ggagatgctgggcatctcagagagc

SEQ ID NO: 5542 - DNA, 25 bp, Homo sapiens
gagatgctgggcatctcagagagcg

SEQ ID NO: 5543 - DNA, 25 bp, Homo sapiens
agatgctgggcatctcagagagcga

SEQ ID NO: 5544 - DNA, 25 bp, Homo sapiens
gatgctgggcatctcagagagcgag

SEQ ID NO: 5545 - DNA, 25 bp, Homo sapiens
atgctgggcatctcagagagcgagc

SEQ ID NO: 5546 - DNA, 25 bp, Homo sapiens
tgctgggcatctcagagagcgagca

SEQ ID NO: 5547 - DNA, 25 bp, Homo sapiens
gctgggcatctcagagagcgagcag

SEQ ID NO: 5548 - DNA, 25 bp, Homo sapiens
ctgggcatctcagagagcgagcagc

SEQ ID NO: 5549 - DNA, 25 bp, Homo sapiens
tgggcatctcagagagcgagcagcg

SEQ ID NO: 5550 - DNA, 25 bp, Homo sapiens
gggcatctcagagagcgagcagcgg

SEQ ID NO: 5551 - DNA, 25 bp, Homo sapiens
ggcatctcagagagcgagcagcggg

SEQ ID NO: 5552 - DNA, 25 bp, Homo sapiens
gcatctcagagagcgagcagcgggc

SEQ ID NO: 5553 - DNA, 25 bp, Homo sapiens
catctcagagagcgagcagcgggct

SEQ ID NO: 5554 - DNA, 25 bp, Homo sapiens
atctcagagagcgagcagcgggctg

SEQ ID NO: 5555 - DNA, 25 bp, Homo sapiens
tctcagagagcgagcagcgggctgt

SEQ ID NO: 5556 - DNA, 25 bp, Homo sapiens
ctcagagagcgagcagcgggctgtt

SEQ ID NO: 5557 - DNA, 25 bp, Homo sapiens
tcagagagcgagcagcgggctgttt

SEQ ID NO: 5558 - DNA, 25 bp, Homo sapiens
cagagagcgagcagcgggctgtttg

SEQ ID NO: 5559 - DNA, 25 bp, Homo sapiens
agagagcgagcagcgggctgtttgg

SEQ ID NO: 5560 - DNA, 25 bp, Homo sapiens
gagagcgagcagcgggctgtttggc

SEQ ID NO: 5561 - DNA, 25 bp, Homo sapiens
agagcgagcagcgggctgtttggcg

SEQ ID NO: 5562 - DNA, 25 bp, Homo sapiens
gagcgagcagcgggctgtttggcgg

SEQ ID NO: 5563 - DNA, 25 bp, Homo sapiens
agcgagcagcgggctgtttggcggg

SEQ ID NO: 5564 - DNA, 25 bp, Homo sapiens
gcgagcagcgggctgtttggcgggt

SEQ ID NO: 5565 - DNA, 25 bp, Homo sapiens
cgagcagcgggctgtttggcgggtc

SEQ ID NO: 5566 - DNA, 25 bp, Homo sapiens
gagcagcgggctgtttggcgggtcc

SEQ ID NO: 5567 - DNA, 25 bp, Homo sapiens
agcagcgggctgtttggcgggtcct

SEQ ID NO: 5568 - DNA, 25 bp, Homo sapiens
gcagcgggctgtttggcgggtcctg

SEQ ID NO: 5569 - DNA, 25 bp, Homo sapiens
cagcgggctgtttggcgggtcctgg

SEQ ID NO: 5570 - DNA, 25 bp, Homo sapiens
agcgggctgtttggcgggtcctggc

SEQ ID NO: 5571 - DNA, 25 bp, Homo sapiens
gcgggctgtttggcgggtcctggca

SEQ ID NO: 5572 - DNA, 25 bp, Homo sapiens
cgggctgtttggcgggtcctggcag

SEQ ID NO: 5573 - DNA, 25 bp, Homo sapiens
gggctgtttggcgggtcctggcagc

SEQ ID NO: 5574 - DNA, 25 bp, Homo sapiens
ggctgtttggcgggtcctggcagcc

SEQ ID NO: 5575 - DNA, 25 bp, Homo sapiens
gctgtttggcgggtcctggcagcca

SEQ ID NO: 5576 - DNA, 25 bp, Homo sapiens
ctgtttggcgggtcctggcagccat

SEQ ID NO: 5577 - DNA, 25 bp, Homo sapiens
tgtttggcgggtcctggcagccatc

SEQ ID NO: 5578 - DNA, 25 bp, Homo sapiens
gtttggcgggtcctggcagccatct

SEQ ID NO: 5579 - DNA, 25 bp, Homo sapiens
tttggcgggtcctggcagccatcta

SEQ ID NO: 5580 - DNA, 25 bp, Homo sapiens
ttggcgggtcctggcagccatctac

SEQ ID NO: 5581 - DNA, 25 bp, Homo sapiens
tggcgggtcctggcagccatctacc

SEQ ID NO: 5582 - DNA, 25 bp, Homo sapiens
ggcgggtcctggcagccatctacca

SEQ ID NO: 5583 - DNA, 25 bp, Homo sapiens
gcgggtcctggcagccatctaccac

SEQ ID NO: 5584 - DNA, 25 bp, Homo sapiens
cgggtcctggcagccatctaccacc

SEQ ID NO: 5585 - DNA, 25 bp, Homo sapiens
gggtcctggcagccatctaccacct

SEQ ID NO: 5586 - DNA, 25 bp, Homo sapiens
ggtcctggcagccatctaccacctg

SEQ ID NO: 5587 - DNA, 25 bp, Homo sapiens
gtcctggcagccatctaccacctgg

SEQ ID NO: 5588 - DNA, 25 bp, Homo sapiens
tcctggcagccatctaccacctggg

SEQ ID NO: 5589 - DNA, 25 bp, Homo sapiens
cctggcagccatctaccacctgggc

SEQ ID NO: 5590 - DNA, 25 bp, Homo sapiens
ctggcagccatctaccacctgggcg

SEQ ID NO: 5591 - DNA, 25 bp, Homo sapiens
tggcagccatctaccacctgggcgc

SEQ ID NO: 5592 - DNA, 25 bp, Homo sapiens
ggcagccatctaccacctgggcgcg

SEQ ID NO: 5593 - DNA, 25 bp, Homo sapiens
gcagccatctaccacctgggcgcgg

SEQ ID NO: 5594 - DNA, 25 bp, Homo sapiens
cagccatctaccacctgggcgcggc

SEQ ID NO: 5595 - DNA, 25 bp, Homo sapiens
agccatctaccacctgggcgcggcg

SEQ ID NO: 5596 - DNA, 25 bp, Homo sapiens
gccatctaccacctgggcgcggcgg

SEQ ID NO: 5597 - DNA, 25 bp, Homo sapiens
ccatctaccacctgggcgcggcggg

SEQ ID NO: 5598 - DNA, 25 bp, Homo sapiens
catctaccacctgggcgcggcgggg

SEQ ID NO: 5599 - DNA, 25 bp, Homo sapiens
atctaccacctgggcgcggcggggg

SEQ ID NO: 5600 - DNA, 25 bp, Homo sapiens
tctaccacctgggcgcggcgggggc

SEQ ID NO: 5601 - DNA, 25 bp, Homo sapiens
ctaccacctgggcgcggcgggggcc

SEQ ID NO: 5602 - DNA, 25 bp, Homo sapiens
taccacctgggcgcggcgggggcct

SEQ ID NO: 5603 - DNA, 25 bp, Homo sapiens
accacctgggcgcggcgggggcctg

SEQ ID NO: 5604 - DNA, 25 bp, Homo sapiens
ccacctgggcgcggcgggggcctgc

SEQ ID NO: 5605 - DNA, 25 bp, Homo sapiens
cacctgggcgcggcgggggcctgca

SEQ ID NO: 5606 - DNA, 25 bp, Homo sapiens
acctgggcgcggcgggggcctgcaa

SEQ ID NO: 5607 - DNA, 25 bp, Homo sapiens
cctgggcgcggcgggggcctgcaaa

SEQ ID NO: 5608 - DNA, 25 bp, Homo sapiens
ctgggcgcggcgggggcctgcaaag

SEQ ID NO: 5609 - DNA, 25 bp, Homo sapiens
tgggcgcggcgggggcctgcaaagt

SEQ ID NO: 5610 - DNA, 25 bp, Homo sapiens
gggcgcggcgggggcctgcaaagtg

SEQ ID NO: 5611 - DNA, 25 bp, Homo sapiens
ggcgcggcgggggcctgcaaagtgg

SEQ ID NO: 5612 - DNA, 25 bp, Homo sapiens
gcgcggcgggggcctgcaaagtggg

SEQ ID NO: 5613 - DNA, 25 bp, Homo sapiens
cgcggcgggggcctgcaaagtgggt

SEQ ID NO: 5614 - DNA, 25 bp, Homo sapiens
gcggcgggggcctgcaaagtgggtc

SEQ ID NO: 5615 - DNA, 25 bp, Homo sapiens
cggcgggggcctgcaaagtgggtcg

SEQ ID NO: 5616 - DNA, 25 bp, Homo sapiens
ggcgggggcctgcaaagtgggtcgg

SEQ ID NO: 5617 - DNA, 25 bp, Homo sapiens
gcgggggcctgcaaagtgggtcgga

SEQ ID NO: 5618 - DNA, 25 bp, Homo sapiens
cgggggcctgcaaagtgggtcggaa

SEQ ID NO: 5619 - DNA, 25 bp, Homo sapiens
gggggcctgcaaagtgggtcggaag

SEQ ID NO: 5620 - DNA, 25 bp, Homo sapiens
ggggcctgcaaagtgggtcggaagc

SEQ ID NO: 5621 - DNA, 25 bp, Homo sapiens
gggcctgcaaagtgggtcggaagca

SEQ ID NO: 5622 - DNA, 25 bp, Homo sapiens
ggcctgcaaagtgggtcggaagcag

SEQ ID NO: 5623 - DNA, 25 bp, Homo sapiens
gcctgcaaagtgggtcggaagcagt

SEQ ID NO: 5624 - DNA, 25 bp, Homo sapiens
cctgcaaagtgggtcggaagcagtt

SEQ ID NO: 5625 - DNA, 25 bp, Homo sapiens
ctgcaaagtgggtcggaagcagttc

SEQ ID NO: 5626 - DNA, 25 bp, Homo sapiens
tgcaaagtgggtcggaagcagttca

SEQ ID NO: 5627 - DNA, 25 bp, Homo sapiens
gcaaagtgggtcggaagcagttcat

SEQ ID NO: 5628 - DNA, 25 bp, Homo sapiens
caaagtgggtcggaagcagttcatg

SEQ ID NO: 5629 - DNA, 25 bp, Homo sapiens
aaagtgggtcggaagcagttcatga

SEQ ID NO: 5630 - DNA, 25 bp, Homo sapiens
aagtgggtcggaagcagttcatgag

SEQ ID NO: 5631 - DNA, 25 bp, Homo sapiens
agtgggtcggaagcagttcatgagg

SEQ ID NO: 5632 - DNA, 25 bp, Homo sapiens
gtgggtcggaagcagttcatgaggt

SEQ ID NO: 5633 - DNA, 25 bp, Homo sapiens
tgggtcggaagcagttcatgaggtt

SEQ ID NO: 5634 - DNA, 25 bp, Homo sapiens
gggtcggaagcagttcatgaggttt

SEQ ID NO: 5635 - DNA, 25 bp, Homo sapiens
ggtcggaagcagttcatgaggtttg

SEQ ID NO: 5636 - DNA, 25 bp, Homo sapiens
gtcggaagcagttcatgaggtttga

SEQ ID NO: 5637 - DNA, 25 bp, Homo sapiens
tcggaagcagttcatgaggtttgag

SEQ ID NO: 5638 - DNA, 25 bp, Homo sapiens
cggaagcagttcatgaggtttgagt

SEQ ID NO: 5639 - DNA, 25 bp, Homo sapiens
ggaagcagttcatgaggtttgagtg

SEQ ID NO: 5640 - DNA, 25 bp, Homo sapiens
gaagcagttcatgaggtttgagtgg

SEQ ID NO: 5641 - DNA, 25 bp, Homo sapiens
aagcagttcatgaggtttgagtggg

SEQ ID NO: 5642 - DNA, 25 bp, Homo sapiens
agcagttcatgaggtttgagtgggc

SEQ ID NO: 5643 - DNA, 25 bp, Homo sapiens
gcagttcatgaggtttgagtgggca

SEQ ID NO: 5644 - DNA, 25 bp, Homo sapiens
cagttcatgaggtttgagtgggcaa

SEQ ID NO: 5645 - DNA, 25 bp, Homo sapiens
agttcatgaggtttgagtgggcaaa

SEQ ID NO: 5646 - DNA, 25 bp, Homo sapiens
gttcatgaggtttgagtgggcaaac

SEQ ID NO: 5647 - DNA, 25 bp, Homo sapiens
ttcatgaggtttgagtgggcaaact

SEQ ID NO: 5648 - DNA, 25 bp, Homo sapiens
tcatgaggtttgagtgggcaaacta

SEQ ID NO: 5649 - DNA, 25 bp, Homo sapiens
catgaggtttgagtgggcaaactac

SEQ ID NO: 5650 - DNA, 25 bp, Homo sapiens
atgaggtttgagtgggcaaactacg

SEQ ID NO: 5651 - DNA, 25 bp, Homo sapiens
tgaggtttgagtgggcaaactacgc

SEQ ID NO: 5652 - DNA, 25 bp, Homo sapiens
gaggtttgagtgggcaaactacgca

SEQ ID NO: 5653 - DNA, 25 bp, Homo sapiens
aggtttgagtgggcaaactacgcag

SEQ ID NO: 5654 - DNA, 25 bp, Homo sapiens
ggtttgagtgggcaaactacgcagc

SEQ ID NO: 5655 - DNA, 25 bp, Homo sapiens
gtttgagtgggcaaactacgcagct

SEQ ID NO: 5656 - DNA, 25 bp, Homo sapiens
tttgagtgggcaaactacgcagctg

SEQ ID NO: 5657 - DNA, 25 bp, Homo sapiens
ttgagtgggcaaactacgcagctga

SEQ ID NO: 5658 - DNA, 25 bp, Homo sapiens
tgagtgggcaaactacgcagctgag

SEQ ID NO: 5659 - DNA, 25 bp, Homo sapiens
gagtgggcaaactacgcagctgagg

SEQ ID NO: 5660 - DNA, 25 bp, Homo sapiens
agtgggcaaactacgcagctgaggc

SEQ ID NO: 5661 - DNA, 25 bp, Homo sapiens
gtgggcaaactacgcagctgaggcc

SEQ ID NO: 5662 - DNA, 25 bp, Homo sapiens
tgggcaaactacgcagctgaggccc

SEQ ID NO: 5663 - DNA, 25 bp, Homo sapiens
gggcaaactacgcagctgaggccct

SEQ ID NO: 5664 - DNA, 25 bp, Homo sapiens
ggcaaactacgcagctgaggccctg

SEQ ID NO: 5665 - DNA, 25 bp, Homo sapiens
gcaaactacgcagctgaggccctgg

SEQ ID NO: 5666 - DNA, 25 bp, Homo sapiens
caaactacgcagctgaggccctggg

SEQ ID NO: 5667 - DNA, 25 bp, Homo sapiens
aaactacgcagctgaggccctgggc

SEQ ID NO: 5668 - DNA, 25 bp, Homo sapiens
aactacgcagctgaggccctgggct

SEQ ID NO: 5669 - DNA, 25 bp, Homo sapiens
actacgcagctgaggccctgggctg

SEQ ID NO: 5670 - DNA, 25 bp, Homo sapiens
ctacgcagctgaggccctgggctgc

SEQ ID NO: 5671 - DNA, 25 bp, Homo sapiens
tacgcagctgaggccctgggctgcg

SEQ ID NO: 5672 - DNA, 25 bp, Homo sapiens
acgcagctgaggccctgggctgcga

SEQ ID NO: 5673 - DNA, 25 bp, Homo sapiens
cgcagctgaggccctgggctgcgag

SEQ ID NO: 5674 - DNA, 25 bp, Homo sapiens
gcagctgaggccctgggctgcgagt

SEQ ID NO: 5675 - DNA, 25 bp, Homo sapiens
cagctgaggccctgggctgcgagta

SEQ ID NO: 5676 - DNA, 25 bp, Homo sapiens
agctgaggccctgggctgcgagtat

SEQ ID NO: 5677 - DNA, 25 bp, Homo sapiens
gctgaggccctgggctgcgagtatg

SEQ ID NO: 5678 - DNA, 25 bp, Homo sapiens
ctgaggccctgggctgcgagtatga

SEQ ID NO: 5679 - DNA, 25 bp, Homo sapiens
tgaggccctgggctgcgagtatgag

SEQ ID NO: 5680 - DNA, 25 bp, Homo sapiens
gaggccctgggctgcgagtatgagg

SEQ ID NO: 5681 - DNA, 25 bp, Homo sapiens
aggccctgggctgcgagtatgagga

SEQ ID NO: 5682 - DNA, 25 bp, Homo sapiens
ggccctgggctgcgagtatgaggag

SEQ ID NO: 5683 - DNA, 25 bp, Homo sapiens
gccctgggctgcgagtatgaggagc

SEQ ID NO: 5684 - DNA, 25 bp, Homo sapiens
ccctgggctgcgagtatgaggagct

SEQ ID NO: 5685 - DNA, 25 bp, Homo sapiens
cctgggctgcgagtatgaggagctg

SEQ ID NO: 5686 - DNA, 25 bp, Homo sapiens
ctgggctgcgagtatgaggagctga

SEQ ID NO: 5687 - DNA, 25 bp, Homo sapiens
tgggctgcgagtatgaggagctgaa

SEQ ID NO: 5688 - DNA, 25 bp, Homo sapiens
gggctgcgagtatgaggagctgaac

SEQ ID NO: 5689 - DNA, 25 bp, Homo sapiens
ggctgcgagtatgaggagctgaaca

SEQ ID NO: 5690 - DNA, 25 bp, Homo sapiens
gctgcgagtatgaggagctgaacac

SEQ ID NO: 5691 - DNA, 25 bp, Homo sapiens
ctgcgagtatgaggagctgaacacg

SEQ ID NO: 5692 - DNA, 25 bp, Homo sapiens
tgcgagtatgaggagctgaacacgg

SEQ ID NO: 5693 - DNA, 25 bp, Homo sapiens
gcgagtatgaggagctgaacacggc

SEQ ID NO: 5694 - DNA, 25 bp, Homo sapiens
cgagtatgaggagctgaacacggcc

SEQ ID NO: 5695 - DNA, 25 bp, Homo sapiens
gagtatgaggagctgaacacggcca

SEQ ID NO: 5696 - DNA, 25 bp, Homo sapiens
agtatgaggagctgaacacggccac

SEQ ID NO: 5697 - DNA, 25 bp, Homo sapiens
gtatgaggagctgaacacggccacc

SEQ ID NO: 5698 - DNA, 25 bp, Homo sapiens
tatgaggagctgaacacggccacct

SEQ ID NO: 5699 - DNA, 25 bp, Homo sapiens
atgaggagctgaacacggccacctt

SEQ ID NO: 5700 - DNA, 25 bp, Homo sapiens
tgaggagctgaacacggccaccttc

SEQ ID NO: 5701 - DNA, 25 bp, Homo sapiens
gaggagctgaacacggccaccttca

SEQ ID NO: 5702 - DNA, 25 bp, Homo sapiens
aggagctgaacacggccaccttcaa

SEQ ID NO: 5703 - DNA, 25 bp, Homo sapiens
ggagctgaacacggccaccttcaag

SEQ ID NO: 5704 - DNA, 25 bp, Homo sapiens
gagctgaacacggccaccttcaagc

SEQ ID NO: 5705 - DNA, 25 bp, Homo sapiens
agctgaacacggccaccttcaagca

SEQ ID NO: 5706 - DNA, 25 bp, Homo sapiens
gctgaacacggccaccttcaagcac

SEQ ID NO: 5707 - DNA, 25 bp, Homo sapiens
ctgaacacggccaccttcaagcacc

SEQ ID NO: 5708 - DNA, 25 bp, Homo sapiens
tgaacacggccaccttcaagcacca

SEQ ID NO: 5709 - DNA, 25 bp, Homo sapiens
gaacacggccaccttcaagcaccac

SEQ ID NO: 5710 - DNA, 25 bp, Homo sapiens
aacacggccaccttcaagcaccacc

SEQ ID NO: 5711 - DNA, 25 bp, Homo sapiens
acacggccaccttcaagcaccacct

SEQ ID NO: 5712 - DNA, 25 bp, Homo sapiens
cacggccaccttcaagcaccacctt

SEQ ID NO: 5713 - DNA, 25 bp, Homo sapiens
acggccaccttcaagcaccaccttc

SEQ ID NO: 5714 - DNA, 25 bp, Homo sapiens
cggccaccttcaagcaccaccttcg

SEQ ID NO: 5715 - DNA, 25 bp, Homo sapiens
ggccaccttcaagcaccaccttcga

SEQ ID NO: 5716 - DNA, 25 bp, Homo sapiens
gccaccttcaagcaccaccttcgac

SEQ ID NO: 5717 - DNA, 25 bp, Homo sapiens
ccaccttcaagcaccaccttcgaca

SEQ ID NO: 5718 - DNA, 25 bp, Homo sapiens
caccttcaagcaccaccttcgacag

SEQ ID NO: 5719 - DNA, 25 bp, Homo sapiens
accttcaagcaccaccttcgacaga

SEQ ID NO: 5720 - DNA, 25 bp, Homo sapiens
ccttcaagcaccaccttcgacagat

SEQ ID NO: 5721 - DNA, 25 bp, Homo sapiens
cttcaagcaccaccttcgacagatc

SEQ ID NO: 5722 - DNA, 25 bp, Homo sapiens
ttcaagcaccaccttcgacagatca

SEQ ID NO: 5723 - DNA, 25 bp, Homo sapiens
tcaagcaccaccttcgacagatcat

SEQ ID NO: 5724 - DNA, 25 bp, Homo sapiens
caagcaccaccttcgacagatcatc

SEQ ID NO: 5725 - DNA, 25 bp, Homo sapiens
aagcaccaccttcgacagatcatcc

SEQ ID NO: 5726 - DNA, 25 bp, Homo sapiens
agcaccaccttcgacagatcatcca

SEQ ID NO: 5727 - DNA, 25 bp, Homo sapiens
gcaccaccttcgacagatcatccag

SEQ ID NO: 5728 - DNA, 25 bp, Homo sapiens
caccaccttcgacagatcatccagc

SEQ ID NO: 5729 - DNA, 25 bp, Homo sapiens
accaccttcgacagatcatccagca

SEQ ID NO: 5730 - DNA, 25 bp, Homo sapiens
ccaccttcgacagatcatccagcaa

SEQ ID NO: 5731 - DNA, 25 bp, Homo sapiens
caccttcgacagatcatccagcaaa

SEQ ID NO: 5732 - DNA, 25 bp, Homo sapiens
accttcgacagatcatccagcaaat

SEQ ID NO: 5733 - DNA, 25 bp, Homo sapiens
ccttcgacagatcatccagcaaatg

SEQ ID NO: 5734 - DNA, 25 bp, Homo sapiens
cttcgacagatcatccagcaaatga

SEQ ID NO: 5735 - DNA, 25 bp, Homo sapiens
ttcgacagatcatccagcaaatgac

SEQ ID NO: 5736 - DNA, 25 bp, Homo sapiens
tcgacagatcatccagcaaatgacg

SEQ ID NO: 5737 - DNA, 25 bp, Homo sapiens
cgacagatcatccagcaaatgacgt

SEQ ID NO: 5738 - DNA, 25 bp, Homo sapiens
gacagatcatccagcaaatgacgtt

SEQ ID NO: 5739 - DNA, 25 bp, Homo sapiens
acagatcatccagcaaatgacgttt

SEQ ID NO: 5740 - DNA, 25 bp, Homo sapiens
cagatcatccagcaaatgacgtttg

SEQ ID NO: 5741 - DNA, 25 bp, Homo sapiens
agatcatccagcaaatgacgtttgg

SEQ ID NO: 5742 - DNA, 25 bp, Homo sapiens
gatcatccagcaaatgacgtttggg

SEQ ID NO: 5743 - DNA, 25 bp, Homo sapiens
atcatccagcaaatgacgtttgggc

SEQ ID NO: 5744 - DNA, 25 bp, Homo sapiens
tcatccagcaaatgacgtttgggcc

SEQ ID NO: 5745 - DNA, 25 bp, Homo sapiens
catccagcaaatgacgtttgggcca

SEQ ID NO: 5746 - DNA, 25 bp, Homo sapiens
atccagcaaatgacgtttgggccaa

SEQ ID NO: 5747 - DNA, 25 bp, Homo sapiens
tccagcaaatgacgtttgggccaag

SEQ ID NO: 5748 - DNA, 25 bp, Homo sapiens
ccagcaaatgacgtttgggccaagc

SEQ ID NO: 5749 - DNA, 25 bp, Homo sapiens
cagcaaatgacgtttgggccaagcc

SEQ ID NO: 5750 - DNA, 25 bp, Homo sapiens
agcaaatgacgtttgggccaagccg

SEQ ID NO: 5751 - DNA, 25 bp, Homo sapiens
gcaaatgacgtttgggccaagccga

SEQ ID NO: 5752 - DNA, 25 bp, Homo sapiens
caaatgacgtttgggccaagccgat

SEQ ID NO: 5753 - DNA, 25 bp, Homo sapiens
aaatgacgtttgggccaagccgatg

SEQ ID NO: 5754 - DNA, 25 bp, Homo sapiens
aatgacgtttgggccaagccgatgg

SEQ ID NO: 5755 - DNA, 25 bp, Homo sapiens
atgacgtttgggccaagccgatggg

SEQ ID NO: 5756 - DNA, 25 bp, Homo sapiens
tgacgtttgggccaagccgatgggg

SEQ ID NO: 5757 - DNA, 25 bp, Homo sapiens
gacgtttgggccaagccgatggggc

SEQ ID NO: 5758 - DNA, 25 bp, Homo sapiens
acgtttgggccaagccgatggggcc

SEQ ID NO: 5759 - DNA, 25 bp, Homo sapiens
cgtttgggccaagccgatggggcct

SEQ ID NO: 5760 - DNA, 25 bp, Homo sapiens
gtttgggccaagccgatggggcctc

SEQ ID NO: 5761 - DNA, 25 bp, Homo sapiens
tttgggccaagccgatggggcctcg

SEQ ID NO: 5762 - DNA, 25 bp, Homo sapiens
ttgggccaagccgatggggcctcga

SEQ ID NO: 5763 - DNA, 25 bp, Homo sapiens
tgggccaagccgatggggcctcgag

SEQ ID NO: 5764 - DNA, 25 bp, Homo sapiens
gggccaagccgatggggcctcgagg

SEQ ID NO: 5765 - DNA, 25 bp, Homo sapiens
ggccaagccgatggggcctcgagga

SEQ ID NO: 5766 - DNA, 25 bp, Homo sapiens
gccaagccgatggggcctcgaggat

SEQ ID NO: 5767 - DNA, 25 bp, Homo sapiens
ccaagccgatggggcctcgaggatg

SEQ ID NO: 5768 - DNA, 25 bp, Homo sapiens
caagccgatggggcctcgaggatga

SEQ ID NO: 5769 - DNA, 25 bp, Homo sapiens
aagccgatggggcctcgaggatgag

SEQ ID NO: 5770 - DNA, 25 bp, Homo sapiens
agccgatggggcctcgaggatgagg

SEQ ID NO: 5771 - DNA, 25 bp, Homo sapiens
gccgatggggcctcgaggatgagga

SEQ ID NO: 5772 - DNA, 25 bp, Homo sapiens
ccgatggggcctcgaggatgaggaa

SEQ ID NO: 5773 - DNA, 25 bp, Homo sapiens
cgatggggcctcgaggatgaggaaa

SEQ ID NO: 5774 - DNA, 25 bp, Homo sapiens
gatggggcctcgaggatgaggaaac

SEQ ID NO: 5775 - DNA, 25 bp, Homo sapiens
atggggcctcgaggatgaggaaacc

SEQ ID NO: 5776 - DNA, 25 bp, Homo sapiens
tggggcctcgaggatgaggaaacca

SEQ ID NO: 5777 - DNA, 25 bp, Homo sapiens
ggggcctcgaggatgaggaaaccag

SEQ ID NO: 5778 - DNA, 25 bp, Homo sapiens
gggcctcgaggatgaggaaaccagc

SEQ ID NO: 5779 - DNA, 25 bp, Homo sapiens
ggcctcgaggatgaggaaaccagct

SEQ ID NO: 5780 - DNA, 25 bp, Homo sapiens
gcctcgaggatgaggaaaccagctc

SEQ ID NO: 5781 - DNA, 25 bp, Homo sapiens
cctcgaggatgaggaaaccagctca

SEQ ID NO: 5782 - DNA, 25 bp, Homo sapiens
ctcgaggatgaggaaaccagctcag

SEQ ID NO: 5783 - DNA, 25 bp, Homo sapiens
tcgaggatgaggaaaccagctcagg

SEQ ID NO: 5784 - DNA, 25 bp, Homo sapiens
cgaggatgaggaaaccagctcaggg

SEQ ID NO: 5785 - DNA, 25 bp, Homo sapiens
gaggatgaggaaaccagctcagggc

SEQ ID NO: 5786 - DNA, 25 bp, Homo sapiens
aggatgaggaaaccagctcagggct

SEQ ID NO: 5787 - DNA, 25 bp, Homo sapiens
ggatgaggaaaccagctcagggctc

SEQ ID NO: 5788 - DNA, 25 bp, Homo sapiens
gatgaggaaaccagctcagggctca

SEQ ID NO: 5789 - DNA, 25 bp, Homo sapiens
atgaggaaaccagctcagggctcaa

SEQ ID NO: 5790 - DNA, 25 bp, Homo sapiens
tgaggaaaccagctcagggctcaag

SEQ ID NO: 5791 - DNA, 25 bp, Homo sapiens
gaggaaaccagctcagggctcaaga

SEQ ID NO: 5792 - DNA, 25 bp, Homo sapiens
aggaaaccagctcagggctcaagat

SEQ ID NO: 5793 - DNA, 25 bp, Homo sapiens
ggaaaccagctcagggctcaagatg

SEQ ID NO: 5794 - DNA, 25 bp, Homo sapiens
gaaaccagctcagggctcaagatga

SEQ ID NO: 5795 - DNA, 25 bp, Homo sapiens
aaaccagctcagggctcaagatgac

SEQ ID NO: 5796 - DNA, 25 bp, Homo sapiens
aaccagctcagggctcaagatgaca

SEQ ID NO: 5797 - DNA, 25 bp, Homo sapiens
accagctcagggctcaagatgacag

SEQ ID NO: 5798 - DNA, 25 bp, Homo sapiens
ccagctcagggctcaagatgacagg

SEQ ID NO: 5799 - DNA, 25 bp, Homo sapiens
cagctcagggctcaagatgacagga

SEQ ID NO: 5800 - DNA, 25 bp, Homo sapiens
agctcagggctcaagatgacaggag

SEQ ID NO: 5801 - DNA, 25 bp, Homo sapiens
gctcagggctcaagatgacaggagt

SEQ ID NO: 5802 - DNA, 25 bp, Homo sapiens
ctcagggctcaagatgacaggagtg

SEQ ID NO: 5803 - DNA, 25 bp, Homo sapiens
tcagggctcaagatgacaggagtgg

SEQ ID NO: 5804 - DNA, 25 bp, Homo sapiens
cagggctcaagatgacaggagtgga

SEQ ID NO: 5805 - DNA, 25 bp, Homo sapiens
agggctcaagatgacaggagtggac

SEQ ID NO: 5806 - DNA, 25 bp, Homo sapiens
gggctcaagatgacaggagtggact

SEQ ID NO: 5807 - DNA, 25 bp, Homo sapiens
ggctcaagatgacaggagtggactg

SEQ ID NO: 5808 - DNA, 25 bp, Homo sapiens
gctcaagatgacaggagtggactgt

SEQ ID NO: 5809 - DNA, 25 bp, Homo sapiens
ctcaagatgacaggagtggactgtg

SEQ ID NO: 5810 - DNA, 25 bp, Homo sapiens
tcaagatgacaggagtggactgtgt

SEQ ID NO: 5811 - DNA, 25 bp, Homo sapiens
caagatgacaggagtggactgtgtg

SEQ ID NO: 5812 - DNA, 25 bp, Homo sapiens
aagatgacaggagtggactgtgtgg

SEQ ID NO: 5813 - DNA, 25 bp, Homo sapiens
agatgacaggagtggactgtgtgga

SEQ ID NO: 5814 - DNA, 25 bp, Homo sapiens
gatgacaggagtggactgtgtggag

SEQ ID NO: 5815 - DNA, 25 bp, Homo sapiens
atgacaggagtggactgtgtggagg

SEQ ID NO: 5816 - DNA, 25 bp, Homo sapiens
tgacaggagtggactgtgtggaggg

SEQ ID NO: 5817 - DNA, 25 bp, Homo sapiens
gacaggagtggactgtgtggagggg

SEQ ID NO: 5818 - DNA, 25 bp, Homo sapiens
acaggagtggactgtgtggagggga

SEQ ID NO: 5819 - DNA, 25 bp, Homo sapiens
caggagtggactgtgtggaggggat

SEQ ID NO: 5820 - DNA, 25 bp, Homo sapiens
aggagtggactgtgtggaggggatg

SEQ ID NO: 5821 - DNA, 25 bp, Homo sapiens
ggagtggactgtgtggaggggatgg

SEQ ID NO: 5822 - DNA, 25 bp, Homo sapiens
gagtggactgtgtggaggggatggc

SEQ ID NO: 5823 - DNA, 25 bp, Homo sapiens
agtggactgtgtggaggggatggcc

SEQ ID NO: 5824 - DNA, 25 bp, Homo sapiens
gtggactgtgtggaggggatggcct

SEQ ID NO: 5825 - DNA, 25 bp, Homo sapiens
tggactgtgtggaggggatggcctc

SEQ ID NO: 5826 - DNA, 25 bp, Homo sapiens
ggactgtgtggaggggatggcctcg

SEQ ID NO: 5827 - DNA, 25 bp, Homo sapiens
gactgtgtggaggggatggcctcgg

SEQ ID NO: 5828 - DNA, 25 bp, Homo sapiens
actgtgtggaggggatggcctcggg

SEQ ID NO: 5829 - DNA, 25 bp, Homo sapiens
ctgtgtggaggggatggcctcgggc

SEQ ID NO: 5830 - DNA, 25 bp, Homo sapiens
tgtgtggaggggatggcctcgggcc

SEQ ID NO: 5831 - DNA, 25 bp, Homo sapiens
gtgtggaggggatggcctcgggcct

SEQ ID NO: 5832 - DNA, 25 bp, Homo sapiens
tgtggaggggatggcctcgggcctg

SEQ ID NO: 5833 - DNA, 25 bp, Homo sapiens
gtggaggggatggcctcgggcctgt

SEQ ID NO: 5834 - DNA, 25 bp, Homo sapiens
tggaggggatggcctcgggcctgta

SEQ ID NO: 5835 - DNA, 25 bp, Homo sapiens
ggaggggatggcctcgggcctgtac

SEQ ID NO: 5836 - DNA, 25 bp, Homo sapiens
gaggggatggcctcgggcctgtacc

SEQ ID NO: 5837 - DNA, 25 bp, Homo sapiens
aggggatggcctcgggcctgtacca

SEQ ID NO: 5838 - DNA, 25 bp, Homo sapiens
ggggatggcctcgggcctgtaccag

SEQ ID NO: 5839 - DNA, 25 bp, Homo sapiens
gggatggcctcgggcctgtaccagg

SEQ ID NO: 5840 - DNA, 25 bp, Homo sapiens
ggatggcctcgggcctgtaccagga

SEQ ID NO: 5841 - DNA, 25 bp, Homo sapiens
gatggcctcgggcctgtaccaggaa

SEQ ID NO: 5842 - DNA, 25 bp, Homo sapiens
atggcctcgggcctgtaccaggaac

SEQ ID NO: 5843 - DNA, 25 bp, Homo sapiens
tggcctcgggcctgtaccaggaact

SEQ ID NO: 5844 - DNA, 25 bp, Homo sapiens
ggcctcgggcctgtaccaggaactc

SEQ ID NO: 5845 - DNA, 25 bp, Homo sapiens
gcctcgggcctgtaccaggaactct

SEQ ID NO: 5846 - DNA, 25 bp, Homo sapiens
cctcgggcctgtaccaggaactctt

SEQ ID NO: 5847 - DNA, 25 bp, Homo sapiens
ctcgggcctgtaccaggaactcttt

SEQ ID NO: 5848 - DNA, 25 bp, Homo sapiens
tcgggcctgtaccaggaactctttg

SEQ ID NO: 5849 - DNA, 25 bp, Homo sapiens
cgggcctgtaccaggaactctttgc

SEQ ID NO: 5850 - DNA, 25 bp, Homo sapiens
gggcctgtaccaggaactctttgcg

SEQ ID NO: 5851 - DNA, 25 bp, Homo sapiens
ggcctgtaccaggaactctttgcgg

SEQ ID NO: 5852 - DNA, 25 bp, Homo sapiens
gcctgtaccaggaactctttgcggc

SEQ ID NO: 5853 - DNA, 25 bp, Homo sapiens
cctgtaccaggaactctttgcggct

SEQ ID NO: 5854 - DNA, 25 bp, Homo sapiens
ctgtaccaggaactctttgcggctg

SEQ ID NO: 5855 - DNA, 25 bp, Homo sapiens
tgtaccaggaactctttgcggctgt

SEQ ID NO: 5856 - DNA, 25 bp, Homo sapiens
gtaccaggaactctttgcggctgtg

SEQ ID NO: 5857 - DNA, 25 bp, Homo sapiens
taccaggaactctttgcggctgtgg

SEQ ID NO: 5858 - DNA, 25 bp, Homo sapiens
accaggaactctttgcggctgtggt

SEQ ID NO: 5859 - DNA, 25 bp, Homo sapiens
ccaggaactctttgcggctgtggtc

SEQ ID NO: 5860 - DNA, 25 bp, Homo sapiens
caggaactctttgcggctgtggtct

SEQ ID NO: 5861 - DNA, 25 bp, Homo sapiens
aggaactctttgcggctgtggtctc

SEQ ID NO: 5862 - DNA, 25 bp, Homo sapiens
ggaactctttgcggctgtggtctca

SEQ ID NO: 5863 - DNA, 25 bp, Homo sapiens
gaactctttgcggctgtggtctcac

SEQ ID NO: 5864 - DNA, 25 bp, Homo sapiens
aactctttgcggctgtggtctcact

SEQ ID NO: 5865 - DNA, 25 bp, Homo sapiens
actctttgcggctgtggtctcactc

SEQ ID NO: 5866 - DNA, 25 bp, Homo sapiens
ctctttgcggctgtggtctcactca

SEQ ID NO: 5867 - DNA, 25 bp, Homo sapiens
tctttgcggctgtggtctcactcat

SEQ ID NO: 5868 - DNA, 25 bp, Homo sapiens
ctttgcggctgtggtctcactcatc

SEQ ID NO: 5869 - DNA, 25 bp, Homo sapiens
tttgcggctgtggtctcactcatca

SEQ ID NO: 5870 - DNA, 25 bp, Homo sapiens
ttgcggctgtggtctcactcatcaa

SEQ ID NO: 5871 - DNA, 25 bp, Homo sapiens
tgcggctgtggtctcactcatcaac

SEQ ID NO: 5872 - DNA, 17 bp, Homo sapiens
cccggacccctccccag

SEQ ID NO: 5873 - DNA, 17 bp, Homo sapiens
ccggacccctccccagg

SEQ ID NO: 5874 - DNA, 17 bp, Homo sapiens
cggacccctccccaggg

SEQ ID NO: 5875 - DNA, 17 bp, Homo sapiens
ggacccctccccaggga

SEQ ID NO: 5876 - DNA, 17 bp, Homo sapiens
gacccctccccagggac

SEQ ID NO: 5877 - DNA, 17 bp, Homo sapiens
acccctccccagggacc

SEQ ID NO: 5878 - DNA, 17 bp, Homo sapiens
cccctccccagggacca

SEQ ID NO: 5879 - DNA, 17 bp, Homo sapiens
ccctccccagggaccac

SEQ ID NO: 5880 - DNA, 17 bp, Homo sapiens
cctccccagggaccacc

SEQ ID NO: 5881 - DNA, 17 bp, Homo sapiens
ctccccagggaccaccg

SEQ ID NO: 5882 - DNA, 17 bp, Homo sapiens
tccccagggaccaccgt

SEQ ID NO: 5883 - DNA, 17 bp, Homo sapiens
ccccagggaccaccgtg

SEQ ID NO: 5884 - DNA, 17 bp, Homo sapiens
cccagggaccaccgtgg

SEQ ID NO: 5885 - DNA, 17 bp, Homo sapiens
ccagggaccaccgtggc

SEQ ID NO: 5886 - DNA, 17 bp, Homo sapiens
cagggaccaccgtggct

SEQ ID NO: 5887 - DNA, 17 bp, Homo sapiens
agggaccaccgtggctg

SEQ ID NO: 5888 - DNA, 17 bp, Homo sapiens
gggaccaccgtggctgt

SEQ ID NO: 5889 - DNA, 17 bp, Homo sapiens
ggaccaccgtggctgtt

SEQ ID NO: 5890 - DNA, 17 bp, Homo sapiens
gaccaccgtggctgttg

SEQ ID NO: 5891 - DNA, 17 bp, Homo sapiens
accaccgtggctgttgt

SEQ ID NO: 5892 - DNA, 17 bp, Homo sapiens
ccaccgtggctgttgtg

SEQ ID NO: 5893 - DNA, 17 bp, Homo sapiens
caccgtggctgttgtgg

SEQ ID NO: 5894 - DNA, 17 bp, Homo sapiens
accgtggctgttgtgga

SEQ ID NO: 5895 - DNA, 17 bp, Homo sapiens
ccgtggctgttgtggat

SEQ ID NO: 5896 - DNA, 17 bp, Homo sapiens
cgtggctgttgtggatc

SEQ ID NO: 5897 - DNA, 17 bp, Homo sapiens
gtggctgttgtggatca

SEQ ID NO: 5898 - DNA, 17 bp, Homo sapiens
tggctgttgtggatcaa

SEQ ID NO: 5899 - DNA, 17 bp, Homo sapiens
ggctgttgtggatcaaa

SEQ ID NO: 5900 - DNA, 17 bp, Homo sapiens
gctgttgtggatcaaaa

SEQ ID NO: 5901 - DNA, 17 bp, Homo sapiens
ctgttgtggatcaaaat

SEQ ID NO: 5902 - DNA, 17 bp, Homo sapiens
tgttgtggatcaaaatc

SEQ ID NO: 5903 - DNA, 17 bp, Homo sapiens
gttgtggatcaaaatcc

SEQ ID NO: 5904 - DNA, 17 bp, Homo sapiens
ttgtggatcaaaatccc

SEQ ID NO: 5905 - DNA, 17 bp, Homo sapiens
tgtggatcaaaatccct

SEQ ID NO: 5906 - DNA, 17 bp, Homo sapiens
gtggatcaaaatccctc

SEQ ID NO: 5907 - DNA, 17 bp, Homo sapiens
tggatcaaaatccctct

SEQ ID NO: 5908 - DNA, 17 bp, Homo sapiens
ggatcaaaatccctctc

SEQ ID NO: 5909 - DNA, 17 bp, Homo sapiens
gatcaaaatccctctca

SEQ ID NO: 5910 - DNA, 17 bp, Homo sapiens
atcaaaatccctctcag

SEQ ID NO: 5911 - DNA, 17 bp, Homo sapiens
tcaaaatccctctcagc

SEQ ID NO: 5912 - DNA, 17 bp, Homo sapiens
caaaatccctctcagca

SEQ ID NO: 5913 - DNA, 17 bp, Homo sapiens
aaaatccctctcagcag

SEQ ID NO: 5914 - DNA, 17 bp, Homo sapiens
aaatccctctcagcagg

SEQ ID NO: 5915 - DNA, 17 bp, Homo sapiens
aatccctctcagcaggt

SEQ ID NO: 5916 - DNA, 17 bp, Homo sapiens
atccctctcagcaggtc

SEQ ID NO: 5917 - DNA, 17 bp, Homo sapiens
tccctctcagcaggtcc

SEQ ID NO: 5918 - DNA, 17 bp, Homo sapiens
ccctctcagcaggtccg

SEQ ID NO: 5919 - DNA, 17 bp, Homo sapiens
cctctcagcaggtccgc

SEQ ID NO: 5920 - DNA, 17 bp, Homo sapiens
ctctcagcaggtccgct

SEQ ID NO: 5921 - DNA, 17 bp, Homo sapiens
tctcagcaggtccgctt

SEQ ID NO: 5922 - DNA, 17 bp, Homo sapiens
ctcagcaggtccgctta

SEQ ID NO: 5923 - DNA, 17 bp, Homo sapiens
tcagcaggtccgcttac

SEQ ID NO: 5924 - DNA, 17 bp, Homo sapiens
cagcaggtccgcttacc

SEQ ID NO: 5925 - DNA, 17 bp, Homo sapiens
agcaggtccgcttacca

SEQ ID NO: 5926 - DNA, 17 bp, Homo sapiens
gcaggtccgcttaccag

SEQ ID NO: 5927 - DNA, 17 bp, Homo sapiens
caggtccgcttaccagc

SEQ ID NO: 5928 - DNA, 17 bp, Homo sapiens
aggtccgcttaccagct

SEQ ID NO: 5929 - DNA, 17 bp, Homo sapiens
ggtccgcttaccagctg

SEQ ID NO: 5930 - DNA, 17 bp, Homo sapiens
gtccgcttaccagctgg

SEQ ID NO: 5931 - DNA, 17 bp, Homo sapiens
tccgcttaccagctgga

SEQ ID NO: 5932 - DNA, 17 bp, Homo sapiens
ccgcttaccagctggag

SEQ ID NO: 5933 - DNA, 17 bp, Homo sapiens
cgcttaccagctggagg

SEQ ID NO: 5934 - DNA, 17 bp, Homo sapiens
gcttaccagctggagga

SEQ ID NO: 5935 - DNA, 17 bp, Homo sapiens
cttaccagctggaggag

SEQ ID NO: 5936 - DNA, 17 bp, Homo sapiens
ttaccagctggaggagg

SEQ ID NO: 5937 - DNA, 17 bp, Homo sapiens
taccagctggaggaggt

SEQ ID NO: 5938 - DNA, 17 bp, Homo sapiens
accagctggaggaggtg

SEQ ID NO: 5939 - DNA, 17 bp, Homo sapiens
ccagctggaggaggtgc

SEQ ID NO: 5940 - DNA, 17 bp, Homo sapiens
cagctggaggaggtgcc

SEQ ID NO: 5941 - DNA, 17 bp, Homo sapiens
agctggaggaggtgccc

SEQ ID NO: 5942 - DNA, 17 bp, Homo sapiens
gctggaggaggtgccca

SEQ ID NO: 5943 - DNA, 17 bp, Homo sapiens
ctggaggaggtgcccag

SEQ ID NO: 5944 - DNA, 17 bp, Homo sapiens
tggaggaggtgcccagg

SEQ ID NO: 5945 - DNA, 17 bp, Homo sapiens
ggaggaggtgcccagga

SEQ ID NO: 5946 - DNA, 17 bp, Homo sapiens
gaggaggtgcccaggat

SEQ ID NO: 5947 - DNA, 17 bp, Homo sapiens
aggaggtgcccaggatg

SEQ ID NO: 5948 - DNA, 17 bp, Homo sapiens
ggaggtgcccaggatgc

SEQ ID NO: 5949 - DNA, 17 bp, Homo sapiens
gaggtgcccaggatgcc

SEQ ID NO: 5950 - DNA, 17 bp, Homo sapiens
aggtgcccaggatgcca

SEQ ID NO: 5951 - DNA, 17 bp, Homo sapiens
ggtgcccaggatgccag

SEQ ID NO: 5952 - DNA, 17 bp, Homo sapiens
gtgcccaggatgccaga

SEQ ID NO: 5953 - DNA, 17 bp, Homo sapiens
tgcccaggatgccagag

SEQ ID NO: 5954 - DNA, 17 bp, Homo sapiens
gcccaggatgccagagg

SEQ ID NO: 5955 - DNA, 17 bp, Homo sapiens
cccaggatgccagaggc

SEQ ID NO: 5956 - DNA, 17 bp, Homo sapiens
ccaggatgccagaggcc

SEQ ID NO: 5957 - DNA, 17 bp, Homo sapiens
caggatgccagaggcct

SEQ ID NO: 5958 - DNA, 17 bp, Homo sapiens
aggatgccagaggcctt

SEQ ID NO: 5959 - DNA, 17 bp, Homo sapiens
ggatgccagaggccttt

SEQ ID NO: 5960 - DNA, 17 bp, Homo sapiens
gatgccagaggcctttt

SEQ ID NO: 5961 - DNA, 17 bp, Homo sapiens
atgccagaggccttttc

SEQ ID NO: 5962 - DNA, 17 bp, Homo sapiens
tgccagaggccttttct

SEQ ID NO: 5963 - DNA, 17 bp, Homo sapiens
gccagaggccttttctg

SEQ ID NO: 5964 - DNA, 17 bp, Homo sapiens
ccagaggccttttctgg

SEQ ID NO: 5965 - DNA, 17 bp, Homo sapiens
cagaggccttttctggg

SEQ ID NO: 5966 - DNA, 17 bp, Homo sapiens
agaggccttttctgggt

SEQ ID NO: 5967 - DNA, 17 bp, Homo sapiens
gaggccttttctgggtc

SEQ ID NO: 5968 - DNA, 17 bp, Homo sapiens
aggccttttctgggtct

SEQ ID NO: 5969 - DNA, 17 bp, Homo sapiens
ggccttttctgggtctt

SEQ ID NO: 5970 - DNA, 17 bp, Homo sapiens
gccttttctgggtctta

SEQ ID NO: 5971 - DNA, 17 bp, Homo sapiens
ccttttctgggtcttag

SEQ ID NO: 5972 - DNA, 17 bp, Homo sapiens
cttttctgggtcttaga

SEQ ID NO: 5973 - DNA, 17 bp, Homo sapiens
ttttctgggtcttagat

SEQ ID NO: 5974 - DNA, 17 bp, Homo sapiens
tttctgggtcttagatg

SEQ ID NO: 5975 - DNA, 17 bp, Homo sapiens
ttctgggtcttagatga

SEQ ID NO: 5976 - DNA, 17 bp, Homo sapiens
tctgggtcttagatgag

SEQ ID NO: 5977 - DNA, 17 bp, Homo sapiens
ctgggtcttagatgagg

SEQ ID NO: 5978 - DNA, 17 bp, Homo sapiens
tgggtcttagatgagga

SEQ ID NO: 5979 - DNA, 17 bp, Homo sapiens
gggtcttagatgaggaa

SEQ ID NO: 5980 - DNA, 17 bp, Homo sapiens
ggtcttagatgaggaag

SEQ ID NO: 5981 - DNA, 17 bp, Homo sapiens
gtcttagatgaggaagt

SEQ ID NO: 5982 - DNA, 17 bp, Homo sapiens
tcttagatgaggaagtc

SEQ ID NO: 5983 - DNA, 17 bp, Homo sapiens
cttagatgaggaagtcc

SEQ ID NO: 5984 - DNA, 17 bp, Homo sapiens
ttagatgaggaagtcca

SEQ ID NO: 5985 - DNA, 17 bp, Homo sapiens
tagatgaggaagtccat

SEQ ID NO: 5986 - DNA, 17 bp, Homo sapiens
agatgaggaagtccatg

SEQ ID NO: 5987 - DNA, 17 bp, Homo sapiens
gatgaggaagtccatgt

SEQ ID NO: 5988 - DNA, 17 bp, Homo sapiens
atgaggaagtccatgta

SEQ ID NO: 5989 - DNA, 17 bp, Homo sapiens
tgaggaagtccatgtag

SEQ ID NO: 5990 - DNA, 17 bp, Homo sapiens
gaggaagtccatgtaga

SEQ ID NO: 5991 - DNA, 17 bp, Homo sapiens
aggaagtccatgtagag

SEQ ID NO: 5992 - DNA, 17 bp, Homo sapiens
ggaagtccatgtagagg

SEQ ID NO: 5993 - DNA, 17 bp, Homo sapiens
gaagtccatgtagaggg

SEQ ID NO: 5994 - DNA, 17 bp, Homo sapiens
aagtccatgtagagggc

SEQ ID NO: 5995 - DNA, 17 bp, Homo sapiens
agtccatgtagagggct

SEQ ID NO: 5996 - DNA, 17 bp, Homo sapiens
gtccatgtagagggctc

SEQ ID NO: 5997 - DNA, 17 bp, Homo sapiens
tccatgtagagggctcc

SEQ ID NO: 5998 - DNA, 17 bp, Homo sapiens
ccatgtagagggctcca

SEQ ID NO: 5999 - DNA, 17 bp, Homo sapiens
catgtagagggctccag

SEQ ID NO: 6000 - DNA, 17 bp, Homo sapiens
atgtagagggctccagt

SEQ ID NO: 6001 - DNA, 17 bp, Homo sapiens
tgtagagggctccagtg

SEQ ID NO: 6002 - DNA, 17 bp, Homo sapiens
gtagagggctccagtga

SEQ ID NO: 6003 - DNA, 17 bp, Homo sapiens
tagagggctccagtgac

SEQ ID NO: 6004 - DNA, 17 bp, Homo sapiens
agagggctccagtgaca

SEQ ID NO: 6005 - DNA, 17 bp, Homo sapiens
gagggctccagtgacag

SEQ ID NO: 6006 - DNA, 17 bp, Homo sapiens
agggctccagtgacagt

SEQ ID NO: 6007 - DNA, 17 bp, Homo sapiens
gggctccagtgacagtg

SEQ ID NO: 6008 - DNA, 17 bp, Homo sapiens
ggctccagtgacagtgt

SEQ ID NO: 6009 - DNA, 17 bp, Homo sapiens
gctccagtgacagtgtg

SEQ ID NO: 6010 - DNA, 17 bp, Homo sapiens
ctccagtgacagtgtgg

SEQ ID NO: 6011 - DNA, 17 bp, Homo sapiens
tccagtgacagtgtggt

SEQ ID NO: 6012 - DNA, 17 bp, Homo sapiens
ccagtgacagtgtggtg

SEQ ID NO: 6013 - DNA, 17 bp, Homo sapiens
cagtgacagtgtggtgc

SEQ ID NO: 6014 - DNA, 17 bp, Homo sapiens
agtgacagtgtggtgct

SEQ ID NO: 6015 - DNA, 17 bp, Homo sapiens
gtgacagtgtggtgctc

SEQ ID NO: 6016 - DNA, 17 bp, Homo sapiens
tgacagtgtggtgctcg

SEQ ID NO: 6017 - DNA, 17 bp, Homo sapiens
gacagtgtggtgctcga

SEQ ID NO: 6018 - DNA, 17 bp, Homo sapiens
acagtgtggtgctcgag

SEQ ID NO: 6019 - DNA, 17 bp, Homo sapiens
cagtgtggtgctcgagc

SEQ ID NO: 6020 - DNA, 17 bp, Homo sapiens
agtgtggtgctcgagcg

SEQ ID NO: 6021 - DNA, 17 bp, Homo sapiens
gtgtggtgctcgagcgt

SEQ ID NO: 6022 - DNA, 17 bp, Homo sapiens
tgtggtgctcgagcgtc

SEQ ID NO: 6023 - DNA, 17 bp, Homo sapiens
gtggtgctcgagcgtct

SEQ ID NO: 6024 - DNA, 17 bp, Homo sapiens
tggtgctcgagcgtctg

SEQ ID NO: 6025 - DNA, 17 bp, Homo sapiens
ggtgctcgagcgtctgt

SEQ ID NO: 6026 - DNA, 17 bp, Homo sapiens
gtgctcgagcgtctgtg

SEQ ID NO: 6027 - DNA, 17 bp, Homo sapiens
tgctcgagcgtctgtgt

SEQ ID NO: 6028 - DNA, 17 bp, Homo sapiens
gctcgagcgtctgtgtg

SEQ ID NO: 6029 - DNA, 17 bp, Homo sapiens
ctcgagcgtctgtgtgc

SEQ ID NO: 6030 - DNA, 17 bp, Homo sapiens
tcgagcgtctgtgtgct

SEQ ID NO: 6031 - DNA, 17 bp, Homo sapiens
cgagcgtctgtgtgcta

SEQ ID NO: 6032 - DNA, 17 bp, Homo sapiens
gagcgtctgtgtgctac

SEQ ID NO: 6033 - DNA, 17 bp, Homo sapiens
agcgtctgtgtgctact

SEQ ID NO: 6034 - DNA, 17 bp, Homo sapiens
gcgtctgtgtgctactt

SEQ ID NO: 6035 - DNA, 17 bp, Homo sapiens
cgtctgtgtgctacttt

SEQ ID NO: 6036 - DNA, 17 bp, Homo sapiens
gtctgtgtgctactttc

SEQ ID NO: 6037 - DNA, 17 bp, Homo sapiens
tctgtgtgctactttcg

SEQ ID NO: 6038 - DNA, 17 bp, Homo sapiens
ctgtgtgctactttcga

SEQ ID NO: 6039 - DNA, 17 bp, Homo sapiens
tgtgtgctactttcgag

SEQ ID NO: 6040 - DNA, 17 bp, Homo sapiens
gtgtgctactttcgaga

SEQ ID NO: 6041 - DNA, 17 bp, Homo sapiens
tgtgctactttcgagaa

SEQ ID NO: 6042 - DNA, 17 bp, Homo sapiens
gtgctactttcgagaag

SEQ ID NO: 6043 - DNA, 17 bp, Homo sapiens
tgctactttcgagaaga

SEQ ID NO: 6044 - DNA, 17 bp, Homo sapiens
gctactttcgagaagaa

SEQ ID NO: 6045 - DNA, 17 bp, Homo sapiens
ctactttcgagaagaaa

SEQ ID NO: 6046 - DNA, 17 bp, Homo sapiens
tactttcgagaagaaag

SEQ ID NO: 6047 - DNA, 17 bp, Homo sapiens
actttcgagaagaaagg

SEQ ID NO: 6048 - DNA, 17 bp, Homo sapiens
ctttcgagaagaaagga

SEQ ID NO: 6049 - DNA, 17 bp, Homo sapiens
tttcgagaagaaaggag

SEQ ID NO: 6050 - DNA, 17 bp, Homo sapiens
ttcgagaagaaaggagc

SEQ ID NO: 6051 - DNA, 17 bp, Homo sapiens
tcgagaagaaaggagct

SEQ ID NO: 6052 - DNA, 17 bp, Homo sapiens
cgagaagaaaggagctg

SEQ ID NO: 6053 - DNA, 17 bp, Homo sapiens
gagaagaaaggagctgg

SEQ ID NO: 6054 - DNA, 17 bp, Homo sapiens
agaagaaaggagctggg

SEQ ID NO: 6055 - DNA, 17 bp, Homo sapiens
gaagaaaggagctggga

SEQ ID NO: 6056 - DNA, 17 bp, Homo sapiens
aagaaaggagctgggac

SEQ ID NO: 6057 - DNA, 17 bp, Homo sapiens
agaaaggagctgggact

SEQ ID NO: 6058 - DNA, 17 bp, Homo sapiens
gaaaggagctgggactg

SEQ ID NO: 6059 - DNA, 17 bp, Homo sapiens
aaaggagctgggactga

SEQ ID NO: 6060 - DNA, 17 bp, Homo sapiens
aaggagctgggactgaa

SEQ ID NO: 6061 - DNA, 17 bp, Homo sapiens
aggagctgggactgaag

SEQ ID NO: 6062 - DNA, 17 bp, Homo sapiens
ggagctgggactgaagg

SEQ ID NO: 6063 - DNA, 17 bp, Homo sapiens
gagctgggactgaaggg

SEQ ID NO: 6064 - DNA, 17 bp, Homo sapiens
agctgggactgaagggt

SEQ ID NO: 6065 - DNA, 17 bp, Homo sapiens
gctgggactgaagggtc

SEQ ID NO: 6066 - DNA, 17 bp, Homo sapiens
ctgggactgaagggtcc

SEQ ID NO: 6067 - DNA, 17 bp, Homo sapiens
tgggactgaagggtcct

SEQ ID NO: 6068 - DNA, 17 bp, Homo sapiens
gggactgaagggtcctc

SEQ ID NO: 6069 - DNA, 17 bp, Homo sapiens
ggactgaagggtcctct

SEQ ID NO: 6070 - DNA, 17 bp, Homo sapiens
gactgaagggtcctctg

SEQ ID NO: 6071 - DNA, 17 bp, Homo sapiens
actgaagggtcctctgc

SEQ ID NO: 6072 - DNA, 17 bp, Homo sapiens
ctgaagggtcctctgcc

SEQ ID NO: 6073 - DNA, 17 bp, Homo sapiens
tgaagggtcctctgccc

SEQ ID NO: 6074 - DNA, 17 bp, Homo sapiens
gaagggtcctctgccct

SEQ ID NO: 6075 - DNA, 17 bp, Homo sapiens
aagggtcctctgccctg

SEQ ID NO: 6076 - DNA, 17 bp, Homo sapiens
agggtcctctgccctgc

SEQ ID NO: 6077 - DNA, 17 bp, Homo sapiens
gggtcctctgccctgcg

SEQ ID NO: 6078 - DNA, 17 bp, Homo sapiens
ggtcctctgccctgcgg

SEQ ID NO: 6079 - DNA, 17 bp, Homo sapiens
gtcctctgccctgcgga

SEQ ID NO: 6080 - DNA, 17 bp, Homo sapiens
tcctctgccctgcggac

SEQ ID NO: 6081 - DNA, 17 bp, Homo sapiens
cctctgccctgcggacc

SEQ ID NO: 6082 - DNA, 17 bp, Homo sapiens
ctctgccctgcggacct

SEQ ID NO: 6083 - DNA, 17 bp, Homo sapiens
tctgccctgcggacctg

SEQ ID NO: 6084 - DNA, 17 bp, Homo sapiens
ctgccctgcggacctgt

SEQ ID NO: 6085 - DNA, 17 bp, Homo sapiens
tgccctgcggacctgtg

SEQ ID NO: 6086 - DNA, 17 bp, Homo sapiens
gccctgcggacctgtga

SEQ ID NO: 6087 - DNA, 17 bp, Homo sapiens
ccctgcggacctgtgag

SEQ ID NO: 6088 - DNA, 17 bp, Homo sapiens
cctgcggacctgtgagc

SEQ ID NO: 6089 - DNA, 17 bp, Homo sapiens
ctgcggacctgtgagca

SEQ ID NO: 6090 - DNA, 17 bp, Homo sapiens
tgcggacctgtgagcag

SEQ ID NO: 6091 - DNA, 17 bp, Homo sapiens
gcggacctgtgagcagc

SEQ ID NO: 6092 - DNA, 17 bp, Homo sapiens
cggacctgtgagcagcc

SEQ ID NO: 6093 - DNA, 17 bp, Homo sapiens
ggacctgtgagcagccc

SEQ ID NO: 6094 - DNA, 17 bp, Homo sapiens
gacctgtgagcagcccc

SEQ ID NO: 6095 - DNA, 17 bp, Homo sapiens
acctgtgagcagcccct

SEQ ID NO: 6096 - DNA, 17 bp, Homo sapiens
cctgtgagcagcccctc

SEQ ID NO: 6097 - DNA, 17 bp, Homo sapiens
ctgtgagcagcccctcc

SEQ ID NO: 6098 - DNA, 17 bp, Homo sapiens
tgtgagcagcccctcca

SEQ ID NO: 6099 - DNA, 17 bp, Homo sapiens
gtgagcagcccctccag

SEQ ID NO: 6100 - DNA, 17 bp, Homo sapiens
tgagcagcccctccagt

SEQ ID NO: 6101 - DNA, 17 bp, Homo sapiens
gagcagcccctccagtg

SEQ ID NO: 6102 - DNA, 17 bp, Homo sapiens
agcagcccctccagtgt

SEQ ID NO: 6103 - DNA, 17 bp, Homo sapiens
gcagcccctccagtgtg

SEQ ID NO: 6104 - DNA, 17 bp, Homo sapiens
cagcccctccagtgtga

SEQ ID NO: 6105 - DNA, 17 bp, Homo sapiens
agcccctccagtgtgag

SEQ ID NO: 6106 - DNA, 17 bp, Homo sapiens
gcccctccagtgtgaga

SEQ ID NO: 6107 - DNA, 17 bp, Homo sapiens
cccctccagtgtgagat

SEQ ID NO: 6108 - DNA, 17 bp, Homo sapiens
ccctccagtgtgagatt

SEQ ID NO: 6109 - DNA, 17 bp, Homo sapiens
cctccagtgtgagattt

SEQ ID NO: 6110 - DNA, 17 bp, Homo sapiens
ctccagtgtgagatttt

SEQ ID NO: 6111 - DNA, 17 bp, Homo sapiens
tccagtgtgagattttc

SEQ ID NO: 6112 - DNA, 17 bp, Homo sapiens
ccagtgtgagattttcc

SEQ ID NO: 6113 - DNA, 17 bp, Homo sapiens
cagtgtgagattttcca

SEQ ID NO: 6114 - DNA, 17 bp, Homo sapiens
agtgtgagattttccac

SEQ ID NO: 6115 - DNA, 17 bp, Homo sapiens
gtgtgagattttccacc

SEQ ID NO: 6116 - DNA, 17 bp, Homo sapiens
tgtgagattttccacca

SEQ ID NO: 6117 - DNA, 17 bp, Homo sapiens
gtgagattttccaccag

SEQ ID NO: 6118 - DNA, 17 bp, Homo sapiens
tgagattttccaccagt

SEQ ID NO: 6119 - DNA, 17 bp, Homo sapiens
gagattttccaccagtt

SEQ ID NO: 6120 - DNA, 17 bp, Homo sapiens
agattttccaccagttg

SEQ ID NO: 6121 - DNA, 17 bp, Homo sapiens
gattttccaccagttgg

SEQ ID NO: 6122 - DNA, 17 bp, Homo sapiens
attttccaccagttggg

SEQ ID NO: 6123 - DNA, 17 bp, Homo sapiens
ttttccaccagttggga

SEQ ID NO: 6124 - DNA, 17 bp, Homo sapiens
tttccaccagttgggat

SEQ ID NO: 6125 - DNA, 17 bp, Homo sapiens
ttccaccagttgggatg

SEQ ID NO: 6126 - DNA, 17 bp, Homo sapiens
tccaccagttgggatgg

SEQ ID NO: 6127 - DNA, 17 bp, Homo sapiens
ccaccagttgggatggg

SEQ ID NO: 6128 - DNA, 17 bp, Homo sapiens
caccagttgggatggga

SEQ ID NO: 6129 - DNA, 17 bp, Homo sapiens
accagttgggatgggac

SEQ ID NO: 6130 - DNA, 17 bp, Homo sapiens
ccagttgggatgggacc

SEQ ID NO: 6131 - DNA, 17 bp, Homo sapiens
cagttgggatgggaccc

SEQ ID NO: 6132 - DNA, 17 bp, Homo sapiens
agttgggatgggaccct

SEQ ID NO: 6133 - DNA, 17 bp, Homo sapiens
gttgggatgggaccctg

SEQ ID NO: 6134 - DNA, 17 bp, Homo sapiens
ttgggatgggaccctgt

SEQ ID NO: 6135 - DNA, 17 bp, Homo sapiens
tgggatgggaccctgtg

SEQ ID NO: 6136 - DNA, 17 bp, Homo sapiens
gggatgggaccctgtgc

SEQ ID NO: 6137 - DNA, 17 bp, Homo sapiens
ggatgggaccctgtgcg

SEQ ID NO: 6138 - DNA, 17 bp, Homo sapiens
gatgggaccctgtgcgg

SEQ ID NO: 6139 - DNA, 17 bp, Homo sapiens
atgggaccctgtgcggt

SEQ ID NO: 6140 - DNA, 17 bp, Homo sapiens
tgggaccctgtgcggta

SEQ ID NO: 6141 - DNA, 17 bp, Homo sapiens
gggaccctgtgcggtac

SEQ ID NO: 6142 - DNA, 17 bp, Homo sapiens
ggaccctgtgcggtacg

SEQ ID NO: 6143 - DNA, 17 bp, Homo sapiens
gaccctgtgcggtacga

SEQ ID NO: 6144 - DNA, 17 bp, Homo sapiens
accctgtgcggtacgac

SEQ ID NO: 6145 - DNA, 17 bp, Homo sapiens
ccctgtgcggtacgacc

SEQ ID NO: 6146 - DNA, 17 bp, Homo sapiens
cctgtgcggtacgacct

SEQ ID NO: 6147 - DNA, 17 bp, Homo sapiens
ctgtgcggtacgacctc

SEQ ID NO: 6148 - DNA, 17 bp, Homo sapiens
tgtgcggtacgacctca

SEQ ID NO: 6149 - DNA, 17 bp, Homo sapiens
gtgcggtacgacctcac

SEQ ID NO: 6150 - DNA, 17 bp, Homo sapiens
tgcggtacgacctcacg

SEQ ID NO: 6151 - DNA, 17 bp, Homo sapiens
gcggtacgacctcacgg

SEQ ID NO: 6152 - DNA, 17 bp, Homo sapiens
cggtacgacctcacggg

SEQ ID NO: 6153 - DNA, 17 bp, Homo sapiens
ggtacgacctcacgggc

SEQ ID NO: 6154 - DNA, 17 bp, Homo sapiens
gtacgacctcacgggct

SEQ ID NO: 6155 - DNA, 17 bp, Homo sapiens
tacgacctcacgggctg

SEQ ID NO: 6156 - DNA, 17 bp, Homo sapiens
acgacctcacgggctgg

SEQ ID NO: 6157 - DNA, 17 bp, Homo sapiens
cgacctcacgggctggc

SEQ ID NO: 6158 - DNA, 17 bp, Homo sapiens
gacctcacgggctggct

SEQ ID NO: 6159 - DNA, 17 bp, Homo sapiens
acctcacgggctggctc

SEQ ID NO: 6160 - DNA, 17 bp, Homo sapiens
cctcacgggctggctcc

SEQ ID NO: 6161 - DNA, 17 bp, Homo sapiens
ctcacgggctggctcca

SEQ ID NO: 6162 - DNA, 17 bp, Homo sapiens
tcacgggctggctccac

SEQ ID NO: 6163 - DNA, 17 bp, Homo sapiens
cacgggctggctccaca

SEQ ID NO: 6164 - DNA, 17 bp, Homo sapiens
acgggctggctccacag

SEQ ID NO: 6165 - DNA, 17 bp, Homo sapiens
cgggctggctccacaga

SEQ ID NO: 6166 - DNA, 17 bp, Homo sapiens
gggctggctccacagag

SEQ ID NO: 6167 - DNA, 17 bp, Homo sapiens
ggctggctccacagagc

SEQ ID NO: 6168 - DNA, 17 bp, Homo sapiens
gctggctccacagagcc

SEQ ID NO: 6169 - DNA, 17 bp, Homo sapiens
ctggctccacagagcca

SEQ ID NO: 6170 - DNA, 17 bp, Homo sapiens
tggctccacagagccaa

SEQ ID NO: 6171 - DNA, 17 bp, Homo sapiens
ggctccacagagccaag

SEQ ID NO: 6172 - DNA, 17 bp, Homo sapiens
gctccacagagccaagc

SEQ ID NO: 6173 - DNA, 17 bp, Homo sapiens
ctccacagagccaagcc

SEQ ID NO: 6174 - DNA, 17 bp, Homo sapiens
tccacagagccaagccc

SEQ ID NO: 6175 - DNA, 17 bp, Homo sapiens
ccacagagccaagccca

SEQ ID NO: 6176 - DNA, 17 bp, Homo sapiens
cacagagccaagcccaa

SEQ ID NO: 6177 - DNA, 17 bp, Homo sapiens
acagagccaagcccaac

SEQ ID NO: 6178 - DNA, 17 bp, Homo sapiens
cagagccaagcccaacc

SEQ ID NO: 6179 - DNA, 17 bp, Homo sapiens
agagccaagcccaacct

SEQ ID NO: 6180 - DNA, 17 bp, Homo sapiens
gagccaagcccaacctc

SEQ ID NO: 6181 - DNA, 17 bp, Homo sapiens
agccaagcccaacctct

SEQ ID NO: 6182 - DNA, 17 bp, Homo sapiens
gccaagcccaacctctc

SEQ ID NO: 6183 - DNA, 17 bp, Homo sapiens
ccaagcccaacctctcg

SEQ ID NO: 6184 - DNA, 17 bp, Homo sapiens
caagcccaacctctcgg

SEQ ID NO: 6185 - DNA, 17 bp, Homo sapiens
aagcccaacctctcggc

SEQ ID NO: 6186 - DNA, 17 bp, Homo sapiens
agcccaacctctcggcc

SEQ ID NO: 6187 - DNA, 17 bp, Homo sapiens
gcccaacctctcggccc

SEQ ID NO: 6188 - DNA, 17 bp, Homo sapiens
cccaacctctcggccct

SEQ ID NO: 6189 - DNA, 17 bp, Homo sapiens
ccaacctctcggccctg

SEQ ID NO: 6190 - DNA, 17 bp, Homo sapiens
caacctctcggccctgg

SEQ ID NO: 6191 - DNA, 17 bp, Homo sapiens
aacctctcggccctgga

SEQ ID NO: 6192 - DNA, 17 bp, Homo sapiens
acctctcggccctggat

SEQ ID NO: 6193 - DNA, 17 bp, Homo sapiens
cctctcggccctggatg

SEQ ID NO: 6194 - DNA, 17 bp, Homo sapiens
ctctcggccctggatgc

SEQ ID NO: 6195 - DNA, 17 bp, Homo sapiens
tctcggccctggatgca

SEQ ID NO: 6196 - DNA, 17 bp, Homo sapiens
ctcggccctggatgcac

SEQ ID NO: 6197 - DNA, 17 bp, Homo sapiens
tcggccctggatgcacc

SEQ ID NO: 6198 - DNA, 17 bp, Homo sapiens
cggccctggatgcaccc

SEQ ID NO: 6199 - DNA, 17 bp, Homo sapiens
ggccctggatgcacccc

SEQ ID NO: 6200 - DNA, 17 bp, Homo sapiens
gccctggatgcacccca

SEQ ID NO: 6201 - DNA, 17 bp, Homo sapiens
ccctggatgcaccccag

SEQ ID NO: 6202 - DNA, 17 bp, Homo sapiens
cctggatgcaccccagg

SEQ ID NO: 6203 - DNA, 17 bp, Homo sapiens
ctggatgcaccccaggt

SEQ ID NO: 6204 - DNA, 17 bp, Homo sapiens
tggatgcaccccaggtc

SEQ ID NO: 6205 - DNA, 17 bp, Homo sapiens
ggatgcaccccaggtcc

SEQ ID NO: 6206 - DNA, 17 bp, Homo sapiens
gatgcaccccaggtcct

SEQ ID NO: 6207 - DNA, 17 bp, Homo sapiens
atgcaccccaggtcctg

SEQ ID NO: 6208 - DNA, 17 bp, Homo sapiens
tgcaccccaggtcctgc

SEQ ID NO: 6209 - DNA, 17 bp, Homo sapiens
gcaccccaggtcctgca

SEQ ID NO: 6210 - DNA, 17 bp, Homo sapiens
caccccaggtcctgcaa

SEQ ID NO: 6211 - DNA, 17 bp, Homo sapiens
accccaggtcctgcaac

SEQ ID NO: 6212 - DNA, 17 bp, Homo sapiens
ccccaggtcctgcaaca

SEQ ID NO: 6213 - DNA, 17 bp, Homo sapiens
cccaggtcctgcaacag

SEQ ID NO: 6214 - DNA, 17 bp, Homo sapiens
ccaggtcctgcaacagt

SEQ ID NO: 6215 - DNA, 17 bp, Homo sapiens
caggtcctgcaacagtc

SEQ ID NO: 6216 - DNA, 17 bp, Homo sapiens
aggtcctgcaacagtca

SEQ ID NO: 6217 - DNA, 17 bp, Homo sapiens
ggtcctgcaacagtcaa

SEQ ID NO: 6218 - DNA, 17 bp, Homo sapiens
gtcctgcaacagtcaaa

SEQ ID NO: 6219 - DNA, 17 bp, Homo sapiens
tcctgcaacagtcaaaa

SEQ ID NO: 6220 - DNA, 17 bp, Homo sapiens
cctgcaacagtcaaaaa

SEQ ID NO: 6221 - DNA, 17 bp, Homo sapiens
ctgcaacagtcaaaaag

SEQ ID NO: 6222 - DNA, 17 bp, Homo sapiens
tgcaacagtcaaaaaga

SEQ ID NO: 6223 - DNA, 17 bp, Homo sapiens
gcaacagtcaaaaagag

SEQ ID NO: 6224 - DNA, 17 bp, Homo sapiens
caacagtcaaaaagaga

SEQ ID NO: 6225 - DNA, 17 bp, Homo sapiens
aacagtcaaaaagagag

SEQ ID NO: 6226 - DNA, 17 bp, Homo sapiens
acagtcaaaaagagagg

SEQ ID NO: 6227 - DNA, 17 bp, Homo sapiens
cagtcaaaaagagagga

SEQ ID NO: 6228 - DNA, 17 bp, Homo sapiens
agtcaaaaagagaggag

SEQ ID NO: 6229 - DNA, 17 bp, Homo sapiens
gtcaaaaagagaggagc

SEQ ID NO: 6230 - DNA, 17 bp, Homo sapiens
tcaaaaagagaggagct

SEQ ID NO: 6231 - DNA, 17 bp, Homo sapiens
caaaaagagaggagctg

SEQ ID NO: 6232 - DNA, 17 bp, Homo sapiens
aaaaagagaggagctgc

SEQ ID NO: 6233 - DNA, 17 bp, Homo sapiens
aaaagagaggagctgcg

SEQ ID NO: 6234 - DNA, 17 bp, Homo sapiens
aaagagaggagctgcgg

SEQ ID NO: 6235 - DNA, 17 bp, Homo sapiens
aagagaggagctgcgga

SEQ ID NO: 6236 - DNA, 17 bp, Homo sapiens
agagaggagctgcggag

SEQ ID NO: 6237 - DNA, 17 bp, Homo sapiens
gagaggagctgcggagt

SEQ ID NO: 6238 - DNA, 17 bp, Homo sapiens
agaggagctgcggagtc

SEQ ID NO: 6239 - DNA, 17 bp, Homo sapiens
gaggagctgcggagtct

SEQ ID NO: 6240 - DNA, 17 bp, Homo sapiens
aggagctgcggagtcta

SEQ ID NO: 6241 - DNA, 17 bp, Homo sapiens
ggagctgcggagtctat

SEQ ID NO: 6242 - DNA, 17 bp, Homo sapiens
gagctgcggagtctatt

SEQ ID NO: 6243 - DNA, 17 bp, Homo sapiens
agctgcggagtctattc

SEQ ID NO: 6244 - DNA, 17 bp, Homo sapiens
gctgcggagtctattcc

SEQ ID NO: 6245 - DNA, 17 bp, Homo sapiens
ctgcggagtctattcca

SEQ ID NO: 6246 - DNA, 17 bp, Homo sapiens
tgcggagtctattccag

SEQ ID NO: 6247 - DNA, 17 bp, Homo sapiens
gcggagtctattccagg

SEQ ID NO: 6248 - DNA, 17 bp, Homo sapiens
cggagtctattccaggc

SEQ ID NO: 6249 - DNA, 17 bp, Homo sapiens
ggagtctattccaggcc

SEQ ID NO: 6250 - DNA, 17 bp, Homo sapiens
gagtctattccaggccc

SEQ ID NO: 6251 - DNA, 17 bp, Homo sapiens
agtctattccaggcccg

SEQ ID NO: 6252 - DNA, 17 bp, Homo sapiens
gtctattccaggcccgg

SEQ ID NO: 6253 - DNA, 17 bp, Homo sapiens
tctattccaggcccggg

SEQ ID NO: 6254 - DNA, 17 bp, Homo sapiens
ctattccaggcccgggc

SEQ ID NO: 6255 - DNA, 17 bp, Homo sapiens
tattccaggcccgggcc

SEQ ID NO: 6256 - DNA, 17 bp, Homo sapiens
attccaggcccgggcca

SEQ ID NO: 6257 - DNA, 17 bp, Homo sapiens
ttccaggcccgggccaa

SEQ ID NO: 6258 - DNA, 17 bp, Homo sapiens
tccaggcccgggccaag

SEQ ID NO: 6259 - DNA, 17 bp, Homo sapiens
ccaggcccgggccaagc

SEQ ID NO: 6260 - DNA, 17 bp, Homo sapiens
caggcccgggccaagct

SEQ ID NO: 6261 - DNA, 17 bp, Homo sapiens
aggcccgggccaagctg

SEQ ID NO: 6262 - DNA, 17 bp, Homo sapiens
ggcccgggccaagctgc

SEQ ID NO: 6263 - DNA, 17 bp, Homo sapiens
gcccgggccaagctgcc

SEQ ID NO: 6264 - DNA, 17 bp, Homo sapiens
cccgggccaagctgcct

SEQ ID NO: 6265 - DNA, 17 bp, Homo sapiens
ccgggccaagctgcctc

SEQ ID NO: 6266 - DNA, 17 bp, Homo sapiens
cgggccaagctgcctcc

SEQ ID NO: 6267 - DNA, 17 bp, Homo sapiens
gggccaagctgcctcct

SEQ ID NO: 6268 - DNA, 17 bp, Homo sapiens
ggccaagctgcctcctg

SEQ ID NO: 6269 - DNA, 17 bp, Homo sapiens
gccaagctgcctcctgt

SEQ ID NO: 6270 - DNA, 17 bp, Homo sapiens
ccaagctgcctcctgtg

SEQ ID NO: 6271 - DNA, 17 bp, Homo sapiens
caagctgcctcctgtgt

SEQ ID NO: 6272 - DNA, 17 bp, Homo sapiens
aagctgcctcctgtgtg

SEQ ID NO: 6273 - DNA, 17 bp, Homo sapiens
agctgcctcctgtgtgc

SEQ ID NO: 6274 - DNA, 17 bp, Homo sapiens
gctgcctcctgtgtgcc

SEQ ID NO: 6275 - DNA, 17 bp, Homo sapiens
ctgcctcctgtgtgccg

SEQ ID NO: 6276 - DNA, 17 bp, Homo sapiens
tgcctcctgtgtgccgg

SEQ ID NO: 6277 - DNA, 17 bp, Homo sapiens
gcctcctgtgtgccggg

SEQ ID NO: 6278 - DNA, 17 bp, Homo sapiens
cctcctgtgtgccgggc

SEQ ID NO: 6279 - DNA, 17 bp, Homo sapiens
ctcctgtgtgccgggct

SEQ ID NO: 6280 - DNA, 17 bp, Homo sapiens
tcctgtgtgccgggctg

SEQ ID NO: 6281 - DNA, 17 bp, Homo sapiens
cctgtgtgccgggctgt

SEQ ID NO: 6282 - DNA, 17 bp, Homo sapiens
ctgtgtgccgggctgtg

SEQ ID NO: 6283 - DNA, 17 bp, Homo sapiens
tgtgtgccgggctgtgg

SEQ ID NO: 6284 - DNA, 17 bp, Homo sapiens
gtgtgccgggctgtggc

SEQ ID NO: 6285 - DNA, 17 bp, Homo sapiens
tgtgccgggctgtggca

SEQ ID NO: 6286 - DNA, 17 bp, Homo sapiens
gtgccgggctgtggcag

SEQ ID NO: 6287 - DNA, 17 bp, Homo sapiens
tgccgggctgtggcagg

SEQ ID NO: 6288 - DNA, 17 bp, Homo sapiens
gccgggctgtggcaggc

SEQ ID NO: 6289 - DNA, 17 bp, Homo sapiens
ccgggctgtggcaggcc

SEQ ID NO: 6290 - DNA, 17 bp, Homo sapiens
cgggctgtggcaggcct

SEQ ID NO: 6291 - DNA, 17 bp, Homo sapiens
gggctgtggcaggcctg

SEQ ID NO: 6292 - DNA, 17 bp, Homo sapiens
ggctgtggcaggcctgg

SEQ ID NO: 6293 - DNA, 17 bp, Homo sapiens
gctgtggcaggcctgga

SEQ ID NO: 6294 - DNA, 17 bp, Homo sapiens
ctgtggcaggcctggag

SEQ ID NO: 6295 - DNA, 17 bp, Homo sapiens
tgtggcaggcctggagg

SEQ ID NO: 6296 - DNA, 17 bp, Homo sapiens
gtggcaggcctggaggg

SEQ ID NO: 6297 - DNA, 17 bp, Homo sapiens
tggcaggcctggagggc

SEQ ID NO: 6298 - DNA, 17 bp, Homo sapiens
ggcaggcctggagggca

SEQ ID NO: 6299 - DNA, 17 bp, Homo sapiens
gcaggcctggagggcac

SEQ ID NO: 6300 - DNA, 17 bp, Homo sapiens
caggcctggagggcacc

SEQ ID NO: 6301 - DNA, 17 bp, Homo sapiens
aggcctggagggcacct

SEQ ID NO: 6302 - DNA, 17 bp, Homo sapiens
ggcctggagggcacctc

SEQ ID NO: 6303 - DNA, 17 bp, Homo sapiens
gcctggagggcacctcc

SEQ ID NO: 6304 - DNA, 17 bp, Homo sapiens
cctggagggcacctccc

SEQ ID NO: 6305 - DNA, 17 bp, Homo sapiens
ctggagggcacctccca

SEQ ID NO: 6306 - DNA, 17 bp, Homo sapiens
tggagggcacctcccag

SEQ ID NO: 6307 - DNA, 17 bp, Homo sapiens
ggagggcacctcccagc

SEQ ID NO: 6308 - DNA, 17 bp, Homo sapiens
gagggcacctcccagca

SEQ ID NO: 6309 - DNA, 17 bp, Homo sapiens
agggcacctcccagcag

SEQ ID NO: 6310 - DNA, 17 bp, Homo sapiens
gggcacctcccagcagg

SEQ ID NO: 6311 - DNA, 17 bp, Homo sapiens
ggcacctcccagcaggc

SEQ ID NO: 6312 - DNA, 17 bp, Homo sapiens
gcacctcccagcaggcc

SEQ ID NO: 6313 - DNA, 17 bp, Homo sapiens
cacctcccagcaggccc

SEQ ID NO: 6314 - DNA, 17 bp, Homo sapiens
acctcccagcaggccct

SEQ ID NO: 6315 - DNA, 17 bp, Homo sapiens
cctcccagcaggccctg

SEQ ID NO: 6316 - DNA, 17 bp, Homo sapiens
ctcccagcaggccctgc

SEQ ID NO: 6317 - DNA, 17 bp, Homo sapiens
tcccagcaggccctgca

SEQ ID NO: 6318 - DNA, 17 bp, Homo sapiens
cccagcaggccctgcag

SEQ ID NO: 6319 - DNA, 17 bp, Homo sapiens
ccagcaggccctgcaga

SEQ ID NO: 6320 - DNA, 17 bp, Homo sapiens
cagcaggccctgcagag

SEQ ID NO: 6321 - DNA, 17 bp, Homo sapiens
agcaggccctgcagagg

SEQ ID NO: 6322 - DNA, 17 bp, Homo sapiens
gcaggccctgcagagga

SEQ ID NO: 6323 - DNA, 17 bp, Homo sapiens
caggccctgcagaggag

SEQ ID NO: 6324 - DNA, 17 bp, Homo sapiens
aggccctgcagaggagc

SEQ ID NO: 6325 - DNA, 17 bp, Homo sapiens
ggccctgcagaggagcc

SEQ ID NO: 6326 - DNA, 17 bp, Homo sapiens
gccctgcagaggagccg

SEQ ID NO: 6327 - DNA, 17 bp, Homo sapiens
ccctgcagaggagccgc

SEQ ID NO: 6328 - DNA, 17 bp, Homo sapiens
cctgcagaggagccgca

SEQ ID NO: 6329 - DNA, 17 bp, Homo sapiens
ctgcagaggagccgcat

SEQ ID NO: 6330 - DNA, 17 bp, Homo sapiens
tgcagaggagccgcatg

SEQ ID NO: 6331 - DNA, 17 bp, Homo sapiens
gcagaggagccgcatgg

SEQ ID NO: 6332 - DNA, 17 bp, Homo sapiens
cagaggagccgcatggt

SEQ ID NO: 6333 - DNA, 17 bp, Homo sapiens
agaggagccgcatggtg

SEQ ID NO: 6334 - DNA, 17 bp, Homo sapiens
gaggagccgcatggtga

SEQ ID NO: 6335 - DNA, 17 bp, Homo sapiens
aggagccgcatggtgag

SEQ ID NO: 6336 - DNA, 17 bp, Homo sapiens
ggagccgcatggtgagg

SEQ ID NO: 6337 - DNA, 17 bp, Homo sapiens
gagccgcatggtgagga

SEQ ID NO: 6338 - DNA, 17 bp, Homo sapiens
agccgcatggtgaggag

SEQ ID NO: 6339 - DNA, 17 bp, Homo sapiens
gccgcatggtgaggagg

SEQ ID NO: 6340 - DNA, 17 bp, Homo sapiens
ccgcatggtgaggagga

SEQ ID NO: 6341 - DNA, 17 bp, Homo sapiens
cgcatggtgaggaggac

SEQ ID NO: 6342 - DNA, 17 bp, Homo sapiens
gcatggtgaggaggacc

SEQ ID NO: 6343 - DNA, 17 bp, Homo sapiens
catggtgaggaggacct

SEQ ID NO: 6344 - DNA, 17 bp, Homo sapiens
atggtgaggaggacctt

SEQ ID NO: 6345 - DNA, 17 bp, Homo sapiens
tggtgaggaggaccttt

SEQ ID NO: 6346 - DNA, 17 bp, Homo sapiens
ggtgaggaggacctttg

SEQ ID NO: 6347 - DNA, 17 bp, Homo sapiens
gtgaggaggacctttgc

SEQ ID NO: 6348 - DNA, 17 bp, Homo sapiens
tgaggaggacctttgcc

SEQ ID NO: 6349 - DNA, 17 bp, Homo sapiens
gaggaggacctttgcca

SEQ ID NO: 6350 - DNA, 17 bp, Homo sapiens
aggaggacctttgccag

SEQ ID NO: 6351 - DNA, 17 bp, Homo sapiens
ggaggacctttgccagc

SEQ ID NO: 6352 - DNA, 17 bp, Homo sapiens
gaggacctttgccagca

SEQ ID NO: 6353 - DNA, 17 bp, Homo sapiens
aggacctttgccagcag

SEQ ID NO: 6354 - DNA, 17 bp, Homo sapiens
ggacctttgccagcagc

SEQ ID NO: 6355 - DNA, 17 bp, Homo sapiens
gacctttgccagcagcc

SEQ ID NO: 6356 - DNA, 17 bp, Homo sapiens
acctttgccagcagcct

SEQ ID NO: 6357 - DNA, 17 bp, Homo sapiens
cctttgccagcagcctt

SEQ ID NO: 6358 - DNA, 17 bp, Homo sapiens
ctttgccagcagccttg

SEQ ID NO: 6359 - DNA, 17 bp, Homo sapiens
tttgccagcagccttgc

SEQ ID NO: 6360 - DNA, 17 bp, Homo sapiens
ttgccagcagccttgcc

SEQ ID NO: 6361 - DNA, 17 bp, Homo sapiens
tgccagcagccttgccg

SEQ ID NO: 6362 - DNA, 17 bp, Homo sapiens
gccagcagccttgccgc

SEQ ID NO: 6363 - DNA, 17 bp, Homo sapiens
ccagcagccttgccgcg

SEQ ID NO: 6364 - DNA, 17 bp, Homo sapiens
cagcagccttgccgcgg

SEQ ID NO: 6365 - DNA, 17 bp, Homo sapiens
agcagccttgccgcggt

SEQ ID NO: 6366 - DNA, 17 bp, Homo sapiens
gcagccttgccgcggtg

SEQ ID NO: 6367 - DNA, 17 bp, Homo sapiens
cagccttgccgcggtga

SEQ ID NO: 6368 - DNA, 17 bp, Homo sapiens
agccttgccgcggtgag

SEQ ID NO: 6369 - DNA, 17 bp, Homo sapiens
gccttgccgcggtgagg

SEQ ID NO: 6370 - DNA, 17 bp, Homo sapiens
ccttgccgcggtgagga

SEQ ID NO: 6371 - DNA, 17 bp, Homo sapiens
cttgccgcggtgaggag

SEQ ID NO: 6372 - DNA, 17 bp, Homo sapiens
ttgccgcggtgaggagg

SEQ ID NO: 6373 - DNA, 17 bp, Homo sapiens
tgccgcggtgaggagga

SEQ ID NO: 6374 - DNA, 17 bp, Homo sapiens
gccgcggtgaggaggaa

SEQ ID NO: 6375 - DNA, 17 bp, Homo sapiens
ccgcggtgaggaggaaa

SEQ ID NO: 6376 - DNA, 17 bp, Homo sapiens
cgcggtgaggaggaaag

SEQ ID NO: 6377 - DNA, 17 bp, Homo sapiens
gcggtgaggaggaaagc

SEQ ID NO: 6378 - DNA, 17 bp, Homo sapiens
cggtgaggaggaaagcc

SEQ ID NO: 6379 - DNA, 17 bp, Homo sapiens
ggtgaggaggaaagccc

SEQ ID NO: 6380 - DNA, 17 bp, Homo sapiens
gtgaggaggaaagcccc

SEQ ID NO: 6381 - DNA, 17 bp, Homo sapiens
tgaggaggaaagccccg

SEQ ID NO: 6382 - DNA, 17 bp, Homo sapiens
gaggaggaaagccccgt

SEQ ID NO: 6383 - DNA, 17 bp, Homo sapiens
aggaggaaagccccgtg

SEQ ID NO: 6384 - DNA, 17 bp, Homo sapiens
ggaggaaagccccgtgc

SEQ ID NO: 6385 - DNA, 17 bp, Homo sapiens
gaggaaagccccgtgct

SEQ ID NO: 6386 - DNA, 17 bp, Homo sapiens
aggaaagccccgtgctc

SEQ ID NO: 6387 - DNA, 17 bp, Homo sapiens
ggaaagccccgtgctcc

SEQ ID NO: 6388 - DNA, 17 bp, Homo sapiens
gaaagccccgtgctccc

SEQ ID NO: 6389 - DNA, 17 bp, Homo sapiens
aaagccccgtgctccca

SEQ ID NO: 6390 - DNA, 17 bp, Homo sapiens
aagccccgtgctcccag

SEQ ID NO: 6391 - DNA, 17 bp, Homo sapiens
agccccgtgctcccaga

SEQ ID NO: 6392 - DNA, 17 bp, Homo sapiens
gccccgtgctcccagat

SEQ ID NO: 6393 - DNA, 17 bp, Homo sapiens
ccccgtgctcccagatc

SEQ ID NO: 6394 - DNA, 17 bp, Homo sapiens
cccgtgctcccagatca

SEQ ID NO: 6395 - DNA, 17 bp, Homo sapiens
ccgtgctcccagatcaa

SEQ ID NO: 6396 - DNA, 17 bp, Homo sapiens
cgtgctcccagatcaag

SEQ ID NO: 6397 - DNA, 17 bp, Homo sapiens
gtgctcccagatcaagc

SEQ ID NO: 6398 - DNA, 17 bp, Homo sapiens
tgctcccagatcaagct

SEQ ID NO: 6399 - DNA, 17 bp, Homo sapiens
gctcccagatcaagctg

SEQ ID NO: 6400 - DNA, 17 bp, Homo sapiens
ctcccagatcaagctgc

SEQ ID NO: 6401 - DNA, 17 bp, Homo sapiens
tcccagatcaagctgca

SEQ ID NO: 6402 - DNA, 17 bp, Homo sapiens
cccagatcaagctgcag

SEQ ID NO: 6403 - DNA, 17 bp, Homo sapiens
ccagatcaagctgcaga

SEQ ID NO: 6404 - DNA, 17 bp, Homo sapiens
cagatcaagctgcagat

SEQ ID NO: 6405 - DNA, 17 bp, Homo sapiens
agatcaagctgcagatg

SEQ ID NO: 6406 - DNA, 17 bp, Homo sapiens
gatcaagctgcagatgg

SEQ ID NO: 6407 - DNA, 17 bp, Homo sapiens
atcaagctgcagatgga

SEQ ID NO: 6408 - DNA, 17 bp, Homo sapiens
tcaagctgcagatggat

SEQ ID NO: 6409 - DNA, 17 bp, Homo sapiens
caagctgcagatggatg

SEQ ID NO: 6410 - DNA, 17 bp, Homo sapiens
aagctgcagatggatgc

SEQ ID NO: 6411 - DNA, 17 bp, Homo sapiens
agctgcagatggatgcg

SEQ ID NO: 6412 - DNA, 17 bp, Homo sapiens
gctgcagatggatgcgc

SEQ ID NO: 6413 - DNA, 17 bp, Homo sapiens
ctgcagatggatgcgct

SEQ ID NO: 6414 - DNA, 17 bp, Homo sapiens
tgcagatggatgcgctg

SEQ ID NO: 6415 - DNA, 17 bp, Homo sapiens
gcagatggatgcgctga

SEQ ID NO: 6416 - DNA, 17 bp, Homo sapiens
cagatggatgcgctgac

SEQ ID NO: 6417 - DNA, 17 bp, Homo sapiens
agatggatgcgctgacc

SEQ ID NO: 6418 - DNA, 17 bp, Homo sapiens
gatggatgcgctgacca

SEQ ID NO: 6419 - DNA, 17 bp, Homo sapiens
atggatgcgctgaccag

SEQ ID NO: 6420 - DNA, 17 bp, Homo sapiens
tggatgcgctgaccagc

SEQ ID NO: 6421 - DNA, 17 bp, Homo sapiens
ggatgcgctgaccagca

SEQ ID NO: 6422 - DNA, 17 bp, Homo sapiens
gatgcgctgaccagcat

SEQ ID NO: 6423 - DNA, 17 bp, Homo sapiens
atgcgctgaccagcatg

SEQ ID NO: 6424 - DNA, 17 bp, Homo sapiens
tgcgctgaccagcatga

SEQ ID NO: 6425 - DNA, 17 bp, Homo sapiens
gcgctgaccagcatgat

SEQ ID NO: 6426 - DNA, 17 bp, Homo sapiens
cgctgaccagcatgatc

SEQ ID NO: 6427 - DNA, 17 bp, Homo sapiens
gctgaccagcatgatca

SEQ ID NO: 6428 - DNA, 17 bp, Homo sapiens
ctgaccagcatgatcaa

SEQ ID NO: 6429 - DNA, 17 bp, Homo sapiens
tgaccagcatgatcaaa

SEQ ID NO: 6430 - DNA, 17 bp, Homo sapiens
gaccagcatgatcaaaa

SEQ ID NO: 6431 - DNA, 17 bp, Homo sapiens
accagcatgatcaaaag

SEQ ID NO: 6432 - DNA, 17 bp, Homo sapiens
ccagcatgatcaaaagg

SEQ ID NO: 6433 - DNA, 17 bp, Homo sapiens
cagcatgatcaaaaggt

SEQ ID NO: 6434 - DNA, 17 bp, Homo sapiens
agcatgatcaaaaggtc

SEQ ID NO: 6435 - DNA, 17 bp, Homo sapiens
gcatgatcaaaaggtcc

SEQ ID NO: 6436 - DNA, 17 bp, Homo sapiens
catgatcaaaaggtccc

SEQ ID NO: 6437 - DNA, 17 bp, Homo sapiens
atgatcaaaaggtcccg

SEQ ID NO: 6438 - DNA, 17 bp, Homo sapiens
tgatcaaaaggtcccgg

SEQ ID NO: 6439 - DNA, 17 bp, Homo sapiens
gatcaaaaggtcccggc

SEQ ID NO: 6440 - DNA, 17 bp, Homo sapiens
atcaaaaggtcccggct

SEQ ID NO: 6441 - DNA, 17 bp, Homo sapiens
tcaaaaggtcccggctg

SEQ ID NO: 6442 - DNA, 17 bp, Homo sapiens
caaaaggtcccggctgc

SEQ ID NO: 6443 - DNA, 17 bp, Homo sapiens
aaaaggtcccggctgca

SEQ ID NO: 6444 - DNA, 17 bp, Homo sapiens
aaaggtcccggctgcac

SEQ ID NO: 6445 - DNA, 17 bp, Homo sapiens
aaggtcccggctgcact

SEQ ID NO: 6446 - DNA, 17 bp, Homo sapiens
aggtcccggctgcactt

SEQ ID NO: 6447 - DNA, 17 bp, Homo sapiens
ggtcccggctgcacttt

SEQ ID NO: 6448 - DNA, 17 bp, Homo sapiens
gtcccggctgcacttta

SEQ ID NO: 6449 - DNA, 17 bp, Homo sapiens
tcccggctgcactttat

SEQ ID NO: 6450 - DNA, 17 bp, Homo sapiens
cccggctgcactttatc

SEQ ID NO: 6451 - DNA, 17 bp, Homo sapiens
ccggctgcactttatcc

SEQ ID NO: 6452 - DNA, 17 bp, Homo sapiens
cggctgcactttatcca

SEQ ID NO: 6453 - DNA, 17 bp, Homo sapiens
ggctgcactttatccac

SEQ ID NO: 6454 - DNA, 17 bp, Homo sapiens
gctgcactttatccact

SEQ ID NO: 6455 - DNA, 17 bp, Homo sapiens
ctgcactttatccactg

SEQ ID NO: 6456 - DNA, 17 bp, Homo sapiens
tgcactttatccactgc

SEQ ID NO: 6457 - DNA, 17 bp, Homo sapiens
gcactttatccactgcc

SEQ ID NO: 6458 - DNA, 17 bp, Homo sapiens
cactttatccactgcct

SEQ ID NO: 6459 - DNA, 17 bp, Homo sapiens
actttatccactgcctg

SEQ ID NO: 6460 - DNA, 17 bp, Homo sapiens
ctttatccactgcctgg

SEQ ID NO: 6461 - DNA, 17 bp, Homo sapiens
tttatccactgcctggt

SEQ ID NO: 6462 - DNA, 17 bp, Homo sapiens
ttatccactgcctggta

SEQ ID NO: 6463 - DNA, 17 bp, Homo sapiens
tatccactgcctggtac

SEQ ID NO: 6464 - DNA, 17 bp, Homo sapiens
atccactgcctggtacc

SEQ ID NO: 6465 - DNA, 17 bp, Homo sapiens
tccactgcctggtacca

SEQ ID NO: 6466 - DNA, 17 bp, Homo sapiens
ccactgcctggtaccaa

SEQ ID NO: 6467 - DNA, 17 bp, Homo sapiens
cactgcctggtaccaaa

SEQ ID NO: 6468 - DNA, 17 bp, Homo sapiens
actgcctggtaccaaac

SEQ ID NO: 6469 - DNA, 17 bp, Homo sapiens
ctgcctggtaccaaacc

SEQ ID NO: 6470 - DNA, 17 bp, Homo sapiens
tgcctggtaccaaaccc

SEQ ID NO: 6471 - DNA, 17 bp, Homo sapiens
gcctggtaccaaaccct

SEQ ID NO: 6472 - DNA, 17 bp, Homo sapiens
cctggtaccaaaccctg

SEQ ID NO: 6473 - DNA, 17 bp, Homo sapiens
ctggtaccaaaccctgt

SEQ ID NO: 6474 - DNA, 17 bp, Homo sapiens
tggtaccaaaccctgtg

SEQ ID NO: 6475 - DNA, 17 bp, Homo sapiens
ggtaccaaaccctgtgg

SEQ ID NO: 6476 - DNA, 17 bp, Homo sapiens
gtaccaaaccctgtggt

SEQ ID NO: 6477 - DNA, 17 bp, Homo sapiens
taccaaaccctgtggtg

SEQ ID NO: 6478 - DNA, 17 bp, Homo sapiens
accaaaccctgtggtgg

SEQ ID NO: 6479 - DNA, 17 bp, Homo sapiens
ccaaaccctgtggtgga

SEQ ID NO: 6480 - DNA, 17 bp, Homo sapiens
caaaccctgtggtggaa

SEQ ID NO: 6481 - DNA, 17 bp, Homo sapiens
aaaccctgtggtggaaa

SEQ ID NO: 6482 - DNA, 17 bp, Homo sapiens
aaccctgtggtggaaag

SEQ ID NO: 6483 - DNA, 17 bp, Homo sapiens
accctgtggtggaaagc

SEQ ID NO: 6484 - DNA, 17 bp, Homo sapiens
ccctgtggtggaaagca

SEQ ID NO: 6485 - DNA, 17 bp, Homo sapiens
cctgtggtggaaagcag

SEQ ID NO: 6486 - DNA, 17 bp, Homo sapiens
ctgtggtggaaagcagg

SEQ ID NO: 6487 - DNA, 17 bp, Homo sapiens
tgtggtggaaagcagga

SEQ ID NO: 6488 - DNA, 17 bp, Homo sapiens
gtggtggaaagcaggag

SEQ ID NO: 6489 - DNA, 17 bp, Homo sapiens
tggtggaaagcaggagt

SEQ ID NO: 6490 - DNA, 17 bp, Homo sapiens
ggtggaaagcaggagtg

SEQ ID NO: 6491 - DNA, 17 bp, Homo sapiens
gtggaaagcaggagtgg

SEQ ID NO: 6492 - DNA, 17 bp, Homo sapiens
tggaaagcaggagtggg

SEQ ID NO: 6493 - DNA, 17 bp, Homo sapiens
ggaaagcaggagtgggc

SEQ ID NO: 6494 - DNA, 17 bp, Homo sapiens
gaaagcaggagtgggca

SEQ ID NO: 6495 - DNA, 17 bp, Homo sapiens
aaagcaggagtgggcag

SEQ ID NO: 6496 - DNA, 17 bp, Homo sapiens
aagcaggagtgggcagg

SEQ ID NO: 6497 - DNA, 17 bp, Homo sapiens
agcaggagtgggcagga

SEQ ID NO: 6498 - DNA, 17 bp, Homo sapiens
gcaggagtgggcaggaa

SEQ ID NO: 6499 - DNA, 17 bp, Homo sapiens
caggagtgggcaggaat

SEQ ID NO: 6500 - DNA, 17 bp, Homo sapiens
aggagtgggcaggaatc

SEQ ID NO: 6501 - DNA, 17 bp, Homo sapiens
ggagtgggcaggaatct

SEQ ID NO: 6502 - DNA, 17 bp, Homo sapiens
gagtgggcaggaatctc

SEQ ID NO: 6503 - DNA, 17 bp, Homo sapiens
agtgggcaggaatctcc

SEQ ID NO: 6504 - DNA, 17 bp, Homo sapiens
gtgggcaggaatctcca

SEQ ID NO: 6505 - DNA, 17 bp, Homo sapiens
tgggcaggaatctccac

SEQ ID NO: 6506 - DNA, 17 bp, Homo sapiens
gggcaggaatctccacc

SEQ ID NO: 6507 - DNA, 17 bp, Homo sapiens
ggcaggaatctccacca

SEQ ID NO: 6508 - DNA, 17 bp, Homo sapiens
gcaggaatctccaccac

SEQ ID NO: 6509 - DNA, 17 bp, Homo sapiens
caggaatctccaccacc

SEQ ID NO: 6510 - DNA, 17 bp, Homo sapiens
aggaatctccaccacca

SEQ ID NO: 6511 - DNA, 17 bp, Homo sapiens
ggaatctccaccaccac

SEQ ID NO: 6512 - DNA, 17 bp, Homo sapiens
gaatctccaccaccacc

SEQ ID NO: 6513 - DNA, 17 bp, Homo sapiens
aatctccaccaccaccg

SEQ ID NO: 6514 - DNA, 17 bp, Homo sapiens
atctccaccaccaccgc

SEQ ID NO: 6515 - DNA, 17 bp, Homo sapiens
tctccaccaccaccgca

SEQ ID NO: 6516 - DNA, 17 bp, Homo sapiens
ctccaccaccaccgcag

SEQ ID NO: 6517 - DNA, 17 bp, Homo sapiens
tccaccaccaccgcagc

SEQ ID NO: 6518 - DNA, 17 bp, Homo sapiens
ccaccaccaccgcagcc

SEQ ID NO: 6519 - DNA, 17 bp, Homo sapiens
caccaccaccgcagcct

SEQ ID NO: 6520 - DNA, 17 bp, Homo sapiens
accaccaccgcagcctg

SEQ ID NO: 6521 - DNA, 17 bp, Homo sapiens
ccaccaccgcagcctgg

SEQ ID NO: 6522 - DNA, 17 bp, Homo sapiens
caccaccgcagcctggt

SEQ ID NO: 6523 - DNA, 17 bp, Homo sapiens
accaccgcagcctggta

SEQ ID NO: 6524 - DNA, 17 bp, Homo sapiens
ccaccgcagcctggtag

SEQ ID NO: 6525 - DNA, 17 bp, Homo sapiens
caccgcagcctggtaga

SEQ ID NO: 6526 - DNA, 17 bp, Homo sapiens
accgcagcctggtagag

SEQ ID NO: 6527 - DNA, 17 bp, Homo sapiens
ccgcagcctggtagaga

SEQ ID NO: 6528 - DNA, 17 bp, Homo sapiens
cgcagcctggtagagac

SEQ ID NO: 6529 - DNA, 17 bp, Homo sapiens
gcagcctggtagagaca

SEQ ID NO: 6530 - DNA, 17 bp, Homo sapiens
cagcctggtagagacaa

SEQ ID NO: 6531 - DNA, 17 bp, Homo sapiens
agcctggtagagacaag

SEQ ID NO: 6532 - DNA, 17 bp, Homo sapiens
gcctggtagagacaagc

SEQ ID NO: 6533 - DNA, 17 bp, Homo sapiens
cctggtagagacaagcc

SEQ ID NO: 6534 - DNA, 17 bp, Homo sapiens
ctggtagagacaagcct

SEQ ID NO: 6535 - DNA, 17 bp, Homo sapiens
tggtagagacaagcctg

SEQ ID NO: 6536 - DNA, 17 bp, Homo sapiens
ggtagagacaagcctgg

SEQ ID NO: 6537 - DNA, 17 bp, Homo sapiens
gtagagacaagcctggg

SEQ ID NO: 6538 - DNA, 17 bp, Homo sapiens
tagagacaagcctgggg

SEQ ID NO: 6539 - DNA, 17 bp, Homo sapiens
agagacaagcctggggc

SEQ ID NO: 6540 - DNA, 17 bp, Homo sapiens
gagacaagcctggggca

SEQ ID NO: 6541 - DNA, 17 bp, Homo sapiens
agacaagcctggggcag

SEQ ID NO: 6542 - DNA, 17 bp, Homo sapiens
gacaagcctggggcagg

SEQ ID NO: 6543 - DNA, 17 bp, Homo sapiens
acaagcctggggcaggt

SEQ ID NO: 6544 - DNA, 17 bp, Homo sapiens
caagcctggggcaggtg

SEQ ID NO: 6545 - DNA, 17 bp, Homo sapiens
aagcctggggcaggtgg

SEQ ID NO: 6546 - DNA, 17 bp, Homo sapiens
agcctggggcaggtgga

SEQ ID NO: 6547 - DNA, 17 bp, Homo sapiens
gcctggggcaggtggac

SEQ ID NO: 6548 - DNA, 17 bp, Homo sapiens
cctggggcaggtggacc

SEQ ID NO: 6549 - DNA, 17 bp, Homo sapiens
ctggggcaggtggacct

SEQ ID NO: 6550 - DNA, 17 bp, Homo sapiens
tggggcaggtggacctc

SEQ ID NO: 6551 - DNA, 17 bp, Homo sapiens
ggggcaggtggacctct

SEQ ID NO: 6552 - DNA, 17 bp, Homo sapiens
gggcaggtggacctctg

SEQ ID NO: 6553 - DNA, 17 bp, Homo sapiens
ggcaggtggacctctgg

SEQ ID NO: 6554 - DNA, 17 bp, Homo sapiens
gcaggtggacctctggc

SEQ ID NO: 6555 - DNA, 17 bp, Homo sapiens
caggtggacctctggcc

SEQ ID NO: 6556 - DNA, 17 bp, Homo sapiens
aggtggacctctggccc

SEQ ID NO: 6557 - DNA, 17 bp, Homo sapiens
ggtggacctctggccct

SEQ ID NO: 6558 - DNA, 17 bp, Homo sapiens
gtggacctctggccctg

SEQ ID NO: 6559 - DNA, 17 bp, Homo sapiens
tggacctctggccctgg

SEQ ID NO: 6560 - DNA, 17 bp, Homo sapiens
ggacctctggccctgga

SEQ ID NO: 6561 - DNA, 17 bp, Homo sapiens
gacctctggccctggat

SEQ ID NO: 6562 - DNA, 17 bp, Homo sapiens
acctctggccctggata

SEQ ID NO: 6563 - DNA, 17 bp, Homo sapiens
cctctggccctggatat

SEQ ID NO: 6564 - DNA, 17 bp, Homo sapiens
ctctggccctggatatc

SEQ ID NO: 6565 - DNA, 17 bp, Homo sapiens
tctggccctggatatcc

SEQ ID NO: 6566 - DNA, 17 bp, Homo sapiens
ctggccctggatatccc

SEQ ID NO: 6567 - DNA, 17 bp, Homo sapiens
tggccctggatatccca

SEQ ID NO: 6568 - DNA, 17 bp, Homo sapiens
ggccctggatatcccag

SEQ ID NO: 6569 - DNA, 17 bp, Homo sapiens
gccctggatatcccagc

SEQ ID NO: 6570 - DNA, 17 bp, Homo sapiens
ccctggatatcccagca

SEQ ID NO: 6571 - DNA, 17 bp, Homo sapiens
cctggatatcccagcac

SEQ ID NO: 6572 - DNA, 17 bp, Homo sapiens
ctggatatcccagcact

SEQ ID NO: 6573 - DNA, 17 bp, Homo sapiens
tggatatcccagcactg

SEQ ID NO: 6574 - DNA, 17 bp, Homo sapiens
ggatatcccagcactga

SEQ ID NO: 6575 - DNA, 17 bp, Homo sapiens
gatatcccagcactgag

SEQ ID NO: 6576 - DNA, 17 bp, Homo sapiens
atatcccagcactgagg

SEQ ID NO: 6577 - DNA, 17 bp, Homo sapiens
tatcccagcactgaggg

SEQ ID NO: 6578 - DNA, 17 bp, Homo sapiens
atcccagcactgagggt

SEQ ID NO: 6579 - DNA, 17 bp, Homo sapiens
tcccagcactgagggtc

SEQ ID NO: 6580 - DNA, 17 bp, Homo sapiens
cccagcactgagggtcc

SEQ ID NO: 6581 - DNA, 17 bp, Homo sapiens
ccagcactgagggtcca

SEQ ID NO: 6582 - DNA, 17 bp, Homo sapiens
cagcactgagggtccag

SEQ ID NO: 6583 - DNA, 17 bp, Homo sapiens
agcactgagggtccagc

SEQ ID NO: 6584 - DNA, 17 bp, Homo sapiens
gcactgagggtccagct

SEQ ID NO: 6585 - DNA, 17 bp, Homo sapiens
cactgagggtccagctt

SEQ ID NO: 6586 - DNA, 17 bp, Homo sapiens
actgagggtccagcttg

SEQ ID NO: 6587 - DNA, 17 bp, Homo sapiens
ctgagggtccagcttgc

SEQ ID NO: 6588 - DNA, 17 bp, Homo sapiens
tgagggtccagcttgct

SEQ ID NO: 6589 - DNA, 17 bp, Homo sapiens
gagggtccagcttgctg

SEQ ID NO: 6590 - DNA, 17 bp, Homo sapiens
agggtccagcttgctgg

SEQ ID NO: 6591 - DNA, 17 bp, Homo sapiens
gggtccagcttgctggg

SEQ ID NO: 6592 - DNA, 17 bp, Homo sapiens
ggtccagcttgctgggt

SEQ ID NO: 6593 - DNA, 17 bp, Homo sapiens
gtccagcttgctgggtt

SEQ ID NO: 6594 - DNA, 17 bp, Homo sapiens
tccagcttgctgggttc

SEQ ID NO: 6595 - DNA, 17 bp, Homo sapiens
ccagcttgctgggttcc

SEQ ID NO: 6596 - DNA, 17 bp, Homo sapiens
cagcttgctgggttcca

SEQ ID NO: 6597 - DNA, 17 bp, Homo sapiens
agcttgctgggttccac

SEQ ID NO: 6598 - DNA, 17 bp, Homo sapiens
gcttgctgggttccaca

SEQ ID NO: 6599 - DNA, 17 bp, Homo sapiens
cttgctgggttccacat

SEQ ID NO: 6600 - DNA, 17 bp, Homo sapiens
ttgctgggttccacatc

SEQ ID NO: 6601 - DNA, 17 bp, Homo sapiens
tgctgggttccacatcc

SEQ ID NO: 6602 - DNA, 17 bp, Homo sapiens
gctgggttccacatcct

SEQ ID NO: 6603 - DNA, 17 bp, Homo sapiens
ctgggttccacatcctg

SEQ ID NO: 6604 - DNA, 17 bp, Homo sapiens
tgggttccacatcctgg

SEQ ID NO: 6605 - DNA, 17 bp, Homo sapiens
gggttccacatcctgga

SEQ ID NO: 6606 - DNA, 17 bp, Homo sapiens
ggttccacatcctggag

SEQ ID NO: 6607 - DNA, 17 bp, Homo sapiens
gttccacatcctggagg

SEQ ID NO: 6608 - DNA, 17 bp, Homo sapiens
ttccacatcctggaggc

SEQ ID NO: 6609 - DNA, 17 bp, Homo sapiens
tccacatcctggaggct

SEQ ID NO: 6610 - DNA, 17 bp, Homo sapiens
ccacatcctggaggctc

SEQ ID NO: 6611 - DNA, 17 bp, Homo sapiens
cacatcctggaggctct

SEQ ID NO: 6612 - DNA, 17 bp, Homo sapiens
acatcctggaggctctg

SEQ ID NO: 6613 - DNA, 17 bp, Homo sapiens
catcctggaggctctgc

SEQ ID NO: 6614 - DNA, 17 bp, Homo sapiens
atcctggaggctctgcg

SEQ ID NO: 6615 - DNA, 17 bp, Homo sapiens
tcctggaggctctgcgt

SEQ ID NO: 6616 - DNA, 17 bp, Homo sapiens
cctggaggctctgcgtc

SEQ ID NO: 6617 - DNA, 17 bp, Homo sapiens
ctggaggctctgcgtct

SEQ ID NO: 6618 - DNA, 17 bp, Homo sapiens
tggaggctctgcgtctg

SEQ ID NO: 6619 - DNA, 17 bp, Homo sapiens
ggaggctctgcgtctgc

SEQ ID NO: 6620 - DNA, 17 bp, Homo sapiens
gaggctctgcgtctgca

SEQ ID NO: 6621 - DNA, 17 bp, Homo sapiens
aggctctgcgtctgcat

SEQ ID NO: 6622 - DNA, 17 bp, Homo sapiens
ggctctgcgtctgcata

SEQ ID NO: 6623 - DNA, 17 bp, Homo sapiens
gctctgcgtctgcatag

SEQ ID NO: 6624 - DNA, 17 bp, Homo sapiens
ctctgcgtctgcatagg

SEQ ID NO: 6625 - DNA, 17 bp, Homo sapiens
tctgcgtctgcatagga

SEQ ID NO: 6626 - DNA, 17 bp, Homo sapiens
ctgcgtctgcataggac

SEQ ID NO: 6627 - DNA, 17 bp, Homo sapiens
tgcgtctgcataggaca

SEQ ID NO: 6628 - DNA, 17 bp, Homo sapiens
gcgtctgcataggacag

SEQ ID NO: 6629 - DNA, 17 bp, Homo sapiens
cgtctgcataggacagg

SEQ ID NO: 6630 - DNA, 17 bp, Homo sapiens
gtctgcataggacaggc

SEQ ID NO: 6631 - DNA, 17 bp, Homo sapiens
tctgcataggacaggct

SEQ ID NO: 6632 - DNA, 17 bp, Homo sapiens
ctgcataggacaggcta

SEQ ID NO: 6633 - DNA, 17 bp, Homo sapiens
tgcataggacaggctat

SEQ ID NO: 6634 - DNA, 17 bp, Homo sapiens
gcataggacaggctatg

SEQ ID NO: 6635 - DNA, 17 bp, Homo sapiens
cataggacaggctatgc

SEQ ID NO: 6636 - DNA, 17 bp, Homo sapiens
ataggacaggctatgct

SEQ ID NO: 6637 - DNA, 17 bp, Homo sapiens
taggacaggctatgctg

SEQ ID NO: 6638 - DNA, 17 bp, Homo sapiens
aggacaggctatgctga

SEQ ID NO: 6639 - DNA, 17 bp, Homo sapiens
ggacaggctatgctgac

SEQ ID NO: 6640 - DNA, 17 bp, Homo sapiens
gacaggctatgctgacc

SEQ ID NO: 6641 - DNA, 17 bp, Homo sapiens
acaggctatgctgacca

SEQ ID NO: 6642 - DNA, 17 bp, Homo sapiens
caggctatgctgaccac

SEQ ID NO: 6643 - DNA, 17 bp, Homo sapiens
aggctatgctgaccaca

SEQ ID NO: 6644 - DNA, 17 bp, Homo sapiens
ggctatgctgaccacat

SEQ ID NO: 6645 - DNA, 17 bp, Homo sapiens
gctatgctgaccacatg

SEQ ID NO: 6646 - DNA, 17 bp, Homo sapiens
ctatgctgaccacatgg

SEQ ID NO: 6647 - DNA, 17 bp, Homo sapiens
tatgctgaccacatggg

SEQ ID NO: 6648 - DNA, 17 bp, Homo sapiens
atgctgaccacatgggg

SEQ ID NO: 6649 - DNA, 17 bp, Homo sapiens
tgctgaccacatggggc

SEQ ID NO: 6650 - DNA, 17 bp, Homo sapiens
gctgaccacatggggct

SEQ ID NO: 6651 - DNA, 17 bp, Homo sapiens
ctgaccacatggggctc

SEQ ID NO: 6652 - DNA, 17 bp, Homo sapiens
tgaccacatggggctca

SEQ ID NO: 6653 - DNA, 17 bp, Homo sapiens
gaccacatggggctcac

SEQ ID NO: 6654 - DNA, 17 bp, Homo sapiens
accacatggggctcact

SEQ ID NO: 6655 - DNA, 17 bp, Homo sapiens
ccacatggggctcactc

SEQ ID NO: 6656 - DNA, 17 bp, Homo sapiens
cacatggggctcactcg

SEQ ID NO: 6657 - DNA, 17 bp, Homo sapiens
acatggggctcactcgc

SEQ ID NO: 6658 - DNA, 17 bp, Homo sapiens
catggggctcactcgct

SEQ ID NO: 6659 - DNA, 17 bp, Homo sapiens
atggggctcactcgctt

SEQ ID NO: 6660 - DNA, 17 bp, Homo sapiens
tggggctcactcgcttc

SEQ ID NO: 6661 - DNA, 17 bp, Homo sapiens
ggggctcactcgcttcc

SEQ ID NO: 6662 - DNA, 17 bp, Homo sapiens
gggctcactcgcttccg

SEQ ID NO: 6663 - DNA, 17 bp, Homo sapiens
ggctcactcgcttccgc

SEQ ID NO: 6664 - DNA, 17 bp, Homo sapiens
gctcactcgcttccgcc

SEQ ID NO: 6665 - DNA, 17 bp, Homo sapiens
ctcactcgcttccgccg

SEQ ID NO: 6666 - DNA, 17 bp, Homo sapiens
tcactcgcttccgccgg

SEQ ID NO: 6667 - DNA, 17 bp, Homo sapiens
cactcgcttccgccggc

SEQ ID NO: 6668 - DNA, 17 bp, Homo sapiens
actcgcttccgccggca

SEQ ID NO: 6669 - DNA, 17 bp, Homo sapiens
ctcgcttccgccggcaa

SEQ ID NO: 6670 - DNA, 17 bp, Homo sapiens
tcgcttccgccggcaat

SEQ ID NO: 6671 - DNA, 17 bp, Homo sapiens
cgcttccgccggcaatt

SEQ ID NO: 6672 - DNA, 17 bp, Homo sapiens
gcttccgccggcaattc

SEQ ID NO: 6673 - DNA, 17 bp, Homo sapiens
cttccgccggcaattcc

SEQ ID NO: 6674 - DNA, 17 bp, Homo sapiens
ttccgccggcaattcca

SEQ ID NO: 6675 - DNA, 17 bp, Homo sapiens
tccgccggcaattccag

SEQ ID NO: 6676 - DNA, 17 bp, Homo sapiens
ccgccggcaattccagg

SEQ ID NO: 6677 - DNA, 17 bp, Homo sapiens
cgccggcaattccaggt

SEQ ID NO: 6678 - DNA, 17 bp, Homo sapiens
gccggcaattccaggtg

SEQ ID NO: 6679 - DNA, 17 bp, Homo sapiens
ccggcaattccaggtgc

SEQ ID NO: 6680 - DNA, 17 bp, Homo sapiens
cggcaattccaggtgct

SEQ ID NO: 6681 - DNA, 17 bp, Homo sapiens
ggcaattccaggtgctg

SEQ ID NO: 6682 - DNA, 17 bp, Homo sapiens
gcaattccaggtgctgg

SEQ ID NO: 6683 - DNA, 17 bp, Homo sapiens
caattccaggtgctgga

SEQ ID NO: 6684 - DNA, 17 bp, Homo sapiens
aattccaggtgctggac

SEQ ID NO: 6685 - DNA, 17 bp, Homo sapiens
attccaggtgctggacg

SEQ ID NO: 6686 - DNA, 17 bp, Homo sapiens
ttccaggtgctggacgc

SEQ ID NO: 6687 - DNA, 17 bp, Homo sapiens
tccaggtgctggacgct

SEQ ID NO: 6688 - DNA, 17 bp, Homo sapiens
ccaggtgctggacgctc

SEQ ID NO: 6689 - DNA, 17 bp, Homo sapiens
caggtgctggacgctcc

SEQ ID NO: 6690 - DNA, 17 bp, Homo sapiens
aggtgctggacgctcca

SEQ ID NO: 6691 - DNA, 17 bp, Homo sapiens
ggtgctggacgctccac

SEQ ID NO: 6692 - DNA, 17 bp, Homo sapiens
gtgctggacgctccact

SEQ ID NO: 6693 - DNA, 17 bp, Homo sapiens
tgctggacgctccactc

SEQ ID NO: 6694 - DNA, 17 bp, Homo sapiens
gctggacgctccactcc

SEQ ID NO: 6695 - DNA, 17 bp, Homo sapiens
ctggacgctccactcct

SEQ ID NO: 6696 - DNA, 17 bp, Homo sapiens
tggacgctccactcctg

SEQ ID NO: 6697 - DNA, 17 bp, Homo sapiens
ggacgctccactcctga

SEQ ID NO: 6698 - DNA, 17 bp, Homo sapiens
gacgctccactcctgaa

SEQ ID NO: 6699 - DNA, 17 bp, Homo sapiens
acgctccactcctgaag

SEQ ID NO: 6700 - DNA, 17 bp, Homo sapiens
cgctccactcctgaaga

SEQ ID NO: 6701 - DNA, 17 bp, Homo sapiens
gctccactcctgaagaa

SEQ ID NO: 6702 - DNA, 17 bp, Homo sapiens
ctccactcctgaagaag

SEQ ID NO: 6703 - DNA, 17 bp, Homo sapiens
tccactcctgaagaagc

SEQ ID NO: 6704 - DNA, 17 bp, Homo sapiens
ccactcctgaagaagct

SEQ ID NO: 6705 - DNA, 17 bp, Homo sapiens
cactcctgaagaagctc

SEQ ID NO: 6706 - DNA, 17 bp, Homo sapiens
actcctgaagaagctca

SEQ ID NO: 6707 - DNA, 17 bp, Homo sapiens
ctcctgaagaagctcat

SEQ ID NO: 6708 - DNA, 17 bp, Homo sapiens
tcctgaagaagctcatg

SEQ ID NO: 6709 - DNA, 17 bp, Homo sapiens
cctgaagaagctcatgt

SEQ ID NO: 6710 - DNA, 17 bp, Homo sapiens
ctgaagaagctcatgtc

SEQ ID NO: 6711 - DNA, 17 bp, Homo sapiens
tgaagaagctcatgtcg

SEQ ID NO: 6712 - DNA, 17 bp, Homo sapiens
gaagaagctcatgtcga

SEQ ID NO: 6713 - DNA, 17 bp, Homo sapiens
aagaagctcatgtcgac

SEQ ID NO: 6714 - DNA, 17 bp, Homo sapiens
agaagctcatgtcgacc

SEQ ID NO: 6715 - DNA, 17 bp, Homo sapiens
gaagctcatgtcgacct

SEQ ID NO: 6716 - DNA, 17 bp, Homo sapiens
aagctcatgtcgacctc

SEQ ID NO: 6717 - DNA, 17 bp, Homo sapiens
agctcatgtcgacctcc

SEQ ID NO: 6718 - DNA, 17 bp, Homo sapiens
gctcatgtcgacctccg

SEQ ID NO: 6719 - DNA, 17 bp, Homo sapiens
ctcatgtcgacctccga

SEQ ID NO: 6720 - DNA, 17 bp, Homo sapiens
tcatgtcgacctccgag

SEQ ID NO: 6721 - DNA, 17 bp, Homo sapiens
catgtcgacctccgagg

SEQ ID NO: 6722 - DNA, 17 bp, Homo sapiens
atgtcgacctccgaggg

SEQ ID NO: 6723 - DNA, 17 bp, Homo sapiens
tgtcgacctccgaggga

SEQ ID NO: 6724 - DNA, 17 bp, Homo sapiens
gtcgacctccgagggaa

SEQ ID NO: 6725 - DNA, 17 bp, Homo sapiens
tcgacctccgagggaat

SEQ ID NO: 6726 - DNA, 17 bp, Homo sapiens
cgacctccgagggaata

SEQ ID NO: 6727 - DNA, 17 bp, Homo sapiens
gacctccgagggaatag

SEQ ID NO: 6728 - DNA, 17 bp, Homo sapiens
acctccgagggaataga

SEQ ID NO: 6729 - DNA, 17 bp, Homo sapiens
cctccgagggaatagat

SEQ ID NO: 6730 - DNA, 17 bp, Homo sapiens
ctccgagggaatagatg

SEQ ID NO: 6731 - DNA, 17 bp, Homo sapiens
tccgagggaatagatga

SEQ ID NO: 6732 - DNA, 17 bp, Homo sapiens
ccgagggaatagatgaa

SEQ ID NO: 6733 - DNA, 17 bp, Homo sapiens
cgagggaatagatgaaa

SEQ ID NO: 6734 - DNA, 17 bp, Homo sapiens
gagggaatagatgaaag

SEQ ID NO: 6735 - DNA, 17 bp, Homo sapiens
agggaatagatgaaagg

SEQ ID NO: 6736 - DNA, 17 bp, Homo sapiens
gggaatagatgaaagga

SEQ ID NO: 6737 - DNA, 17 bp, Homo sapiens
ggaatagatgaaaggaa

SEQ ID NO: 6738 - DNA, 17 bp, Homo sapiens
gaatagatgaaaggaag

SEQ ID NO: 6739 - DNA, 17 bp, Homo sapiens
aatagatgaaaggaagg

SEQ ID NO: 6740 - DNA, 17 bp, Homo sapiens
atagatgaaaggaaggc

SEQ ID NO: 6741 - DNA, 17 bp, Homo sapiens
tagatgaaaggaaggcc

SEQ ID NO: 6742 - DNA, 17 bp, Homo sapiens
agatgaaaggaaggccg

SEQ ID NO: 6743 - DNA, 17 bp, Homo sapiens
gatgaaaggaaggccgt

SEQ ID NO: 6744 - DNA, 17 bp, Homo sapiens
atgaaaggaaggccgtg

SEQ ID NO: 6745 - DNA, 17 bp, Homo sapiens
tgaaaggaaggccgtgg

SEQ ID NO: 6746 - DNA, 17 bp, Homo sapiens
gaaaggaaggccgtgga

SEQ ID NO: 6747 - DNA, 17 bp, Homo sapiens
aaaggaaggccgtggag

SEQ ID NO: 6748 - DNA, 17 bp, Homo sapiens
aaggaaggccgtggagg

SEQ ID NO: 6749 - DNA, 17 bp, Homo sapiens
aggaaggccgtggagga

SEQ ID NO: 6750 - DNA, 17 bp, Homo sapiens
ggaaggccgtggaggag

SEQ ID NO: 6751 - DNA, 17 bp, Homo sapiens
gaaggccgtggaggagc

SEQ ID NO: 6752 - DNA, 17 bp, Homo sapiens
aaggccgtggaggagct

SEQ ID NO: 6753 - DNA, 17 bp, Homo sapiens
aggccgtggaggagctc

SEQ ID NO: 6754 - DNA, 17 bp, Homo sapiens
ggccgtggaggagctcc

SEQ ID NO: 6755 - DNA, 17 bp, Homo sapiens
gccgtggaggagctcct

SEQ ID NO: 6756 - DNA, 17 bp, Homo sapiens
ccgtggaggagctcctg

SEQ ID NO: 6757 - DNA, 17 bp, Homo sapiens
cgtggaggagctcctgg

SEQ ID NO: 6758 - DNA, 17 bp, Homo sapiens
gtggaggagctcctgga

SEQ ID NO: 6759 - DNA, 17 bp, Homo sapiens
tggaggagctcctggag

SEQ ID NO: 6760 - DNA, 17 bp, Homo sapiens
ggaggagctcctggaga

SEQ ID NO: 6761 - DNA, 17 bp, Homo sapiens
gaggagctcctggagac

SEQ ID NO: 6762 - DNA, 17 bp, Homo sapiens
aggagctcctggagacc

SEQ ID NO: 6763 - DNA, 17 bp, Homo sapiens
ggagctcctggagaccc

SEQ ID NO: 6764 - DNA, 17 bp, Homo sapiens
gagctcctggagaccct

SEQ ID NO: 6765 - DNA, 17 bp, Homo sapiens
agctcctggagaccctg

SEQ ID NO: 6766 - DNA, 17 bp, Homo sapiens
gctcctggagaccctgg

SEQ ID NO: 6767 - DNA, 17 bp, Homo sapiens
ctcctggagaccctgga

SEQ ID NO: 6768 - DNA, 17 bp, Homo sapiens
tcctggagaccctggat

SEQ ID NO: 6769 - DNA, 17 bp, Homo sapiens
cctggagaccctggatc

SEQ ID NO: 6770 - DNA, 17 bp, Homo sapiens
ctggagaccctggatct

SEQ ID NO: 6771 - DNA, 17 bp, Homo sapiens
tggagaccctggatctg

SEQ ID NO: 6772 - DNA, 17 bp, Homo sapiens
ggagaccctggatctgg

SEQ ID NO: 6773 - DNA, 17 bp, Homo sapiens
gagaccctggatctgga

SEQ ID NO: 6774 - DNA, 17 bp, Homo sapiens
agaccctggatctggaa

SEQ ID NO: 6775 - DNA, 17 bp, Homo sapiens
gaccctggatctggaaa

SEQ ID NO: 6776 - DNA, 17 bp, Homo sapiens
accctggatctggaaaa

SEQ ID NO: 6777 - DNA, 17 bp, Homo sapiens
ccctggatctggaaaag

SEQ ID NO: 6778 - DNA, 17 bp, Homo sapiens
cctggatctggaaaaga

SEQ ID NO: 6779 - DNA, 17 bp, Homo sapiens
ctggatctggaaaagaa

SEQ ID NO: 6780 - DNA, 17 bp, Homo sapiens
tggatctggaaaagaag

SEQ ID NO: 6781 - DNA, 17 bp, Homo sapiens
ggatctggaaaagaagg

SEQ ID NO: 6782 - DNA, 17 bp, Homo sapiens
gatctggaaaagaaggc

SEQ ID NO: 6783 - DNA, 17 bp, Homo sapiens
atctggaaaagaaggcg

SEQ ID NO: 6784 - DNA, 17 bp, Homo sapiens
tctggaaaagaaggcgg

SEQ ID NO: 6785 - DNA, 17 bp, Homo sapiens
ctggaaaagaaggcggt

SEQ ID NO: 6786 - DNA, 17 bp, Homo sapiens
tggaaaagaaggcggtg

SEQ ID NO: 6787 - DNA, 17 bp, Homo sapiens
ggaaaagaaggcggtgg

SEQ ID NO: 6788 - DNA, 17 bp, Homo sapiens
gaaaagaaggcggtggc

SEQ ID NO: 6789 - DNA, 17 bp, Homo sapiens
aaaagaaggcggtggct

SEQ ID NO: 6790 - DNA, 17 bp, Homo sapiens
aaagaaggcggtggctg

SEQ ID NO: 6791 - DNA, 17 bp, Homo sapiens
aagaaggcggtggctgt

SEQ ID NO: 6792 - DNA, 17 bp, Homo sapiens
agaaggcggtggctgtg

SEQ ID NO: 6793 - DNA, 17 bp, Homo sapiens
gaaggcggtggctgtgg

SEQ ID NO: 6794 - DNA, 17 bp, Homo sapiens
aaggcggtggctgtggg

SEQ ID NO: 6795 - DNA, 17 bp, Homo sapiens
aggcggtggctgtgggg

SEQ ID NO: 6796 - DNA, 17 bp, Homo sapiens
ggcggtggctgtggggc

SEQ ID NO: 6797 - DNA, 17 bp, Homo sapiens
gcggtggctgtggggca

SEQ ID NO: 6798 - DNA, 17 bp, Homo sapiens
cggtggctgtggggcac

SEQ ID NO: 6799 - DNA, 17 bp, Homo sapiens
ggtggctgtggggcaca

SEQ ID NO: 6800 - DNA, 17 bp, Homo sapiens
gtggctgtggggcacag

SEQ ID NO: 6801 - DNA, 17 bp, Homo sapiens
tggctgtggggcacagc

SEQ ID NO: 6802 - DNA, 17 bp, Homo sapiens
ggctgtggggcacagcc

SEQ ID NO: 6803 - DNA, 17 bp, Homo sapiens
gctgtggggcacagcca

SEQ ID NO: 6804 - DNA, 17 bp, Homo sapiens
ctgtggggcacagccaa

SEQ ID NO: 6805 - DNA, 17 bp, Homo sapiens
tgtggggcacagccaag

SEQ ID NO: 6806 - DNA, 17 bp, Homo sapiens
gtggggcacagccaagt

SEQ ID NO: 6807 - DNA, 17 bp, Homo sapiens
tggggcacagccaagtt

SEQ ID NO: 6808 - DNA, 17 bp, Homo sapiens
ggggcacagccaagttt

SEQ ID NO: 6809 - DNA, 17 bp, Homo sapiens
gggcacagccaagtttt

SEQ ID NO: 6810 - DNA, 17 bp, Homo sapiens
ggcacagccaagttttt

SEQ ID NO: 6811 - DNA, 17 bp, Homo sapiens
gcacagccaagtttttc

SEQ ID NO: 6812 - DNA, 17 bp, Homo sapiens
cacagccaagtttttct

SEQ ID NO: 6813 - DNA, 17 bp, Homo sapiens
acagccaagtttttctc

SEQ ID NO: 6814 - DNA, 17 bp, Homo sapiens
cagccaagtttttctca

SEQ ID NO: 6815 - DNA, 17 bp, Homo sapiens
agccaagtttttctcaa

SEQ ID NO: 6816 - DNA, 17 bp, Homo sapiens
gccaagtttttctcaag

SEQ ID NO: 6817 - DNA, 17 bp, Homo sapiens
ccaagtttttctcaagg

SEQ ID NO: 6818 - DNA, 17 bp, Homo sapiens
caagtttttctcaaggc

SEQ ID NO: 6819 - DNA, 17 bp, Homo sapiens
aagtttttctcaaggca

SEQ ID NO: 6820 - DNA, 17 bp, Homo sapiens
agtttttctcaaggcag

SEQ ID NO: 6821 - DNA, 17 bp, Homo sapiens
gtttttctcaaggcagg

SEQ ID NO: 6822 - DNA, 17 bp, Homo sapiens
tttttctcaaggcaggt

SEQ ID NO: 6823 - DNA, 17 bp, Homo sapiens
ttttctcaaggcaggtg

SEQ ID NO: 6824 - DNA, 17 bp, Homo sapiens
tttctcaaggcaggtgt

SEQ ID NO: 6825 - DNA, 17 bp, Homo sapiens
ttctcaaggcaggtgtg

SEQ ID NO: 6826 - DNA, 17 bp, Homo sapiens
tctcaaggcaggtgtga

SEQ ID NO: 6827 - DNA, 17 bp, Homo sapiens
ctcaaggcaggtgtgat

SEQ ID NO: 6828 - DNA, 17 bp, Homo sapiens
tcaaggcaggtgtgatc

SEQ ID NO: 6829 - DNA, 17 bp, Homo sapiens
caaggcaggtgtgatct

SEQ ID NO: 6830 - DNA, 17 bp, Homo sapiens
aaggcaggtgtgatctc

SEQ ID NO: 6831 - DNA, 17 bp, Homo sapiens
aggcaggtgtgatctcc

SEQ ID NO: 6832 - DNA, 17 bp, Homo sapiens
ggcaggtgtgatctcca

SEQ ID NO: 6833 - DNA, 17 bp, Homo sapiens
gcaggtgtgatctccag

SEQ ID NO: 6834 - DNA, 17 bp, Homo sapiens
caggtgtgatctccagg

SEQ ID NO: 6835 - DNA, 17 bp, Homo sapiens
aggtgtgatctccaggc

SEQ ID NO: 6836 - DNA, 17 bp, Homo sapiens
ggtgtgatctccaggct

SEQ ID NO: 6837 - DNA, 17 bp, Homo sapiens
gtgtgatctccaggctt

SEQ ID NO: 6838 - DNA, 17 bp, Homo sapiens
tgtgatctccaggcttg

SEQ ID NO: 6839 - DNA, 17 bp, Homo sapiens
gtgatctccaggcttga

SEQ ID NO: 6840 - DNA, 17 bp, Homo sapiens
tgatctccaggcttgag

SEQ ID NO: 6841 - DNA, 17 bp, Homo sapiens
gatctccaggcttgaga

SEQ ID NO: 6842 - DNA, 17 bp, Homo sapiens
atctccaggcttgagaa

SEQ ID NO: 6843 - DNA, 17 bp, Homo sapiens
tctccaggcttgagaag

SEQ ID NO: 6844 - DNA, 17 bp, Homo sapiens
ctccaggcttgagaagc

SEQ ID NO: 6845 - DNA, 17 bp, Homo sapiens
tccaggcttgagaagca

SEQ ID NO: 6846 - DNA, 17 bp, Homo sapiens
ccaggcttgagaagcag

SEQ ID NO: 6847 - DNA, 17 bp, Homo sapiens
caggcttgagaagcagc

SEQ ID NO: 6848 - DNA, 17 bp, Homo sapiens
aggcttgagaagcagcg

SEQ ID NO: 6849 - DNA, 17 bp, Homo sapiens
ggcttgagaagcagcga

SEQ ID NO: 6850 - DNA, 17 bp, Homo sapiens
gcttgagaagcagcgag

SEQ ID NO: 6851 - DNA, 17 bp, Homo sapiens
cttgagaagcagcgaga

SEQ ID NO: 6852 - DNA, 17 bp, Homo sapiens
ttgagaagcagcgagag

SEQ ID NO: 6853 - DNA, 17 bp, Homo sapiens
tgagaagcagcgagaga

SEQ ID NO: 6854 - DNA, 17 bp, Homo sapiens
gagaagcagcgagagaa

SEQ ID NO: 6855 - DNA, 17 bp, Homo sapiens
agaagcagcgagagaag

SEQ ID NO: 6856 - DNA, 17 bp, Homo sapiens
gaagcagcgagagaagc

SEQ ID NO: 6857 - DNA, 17 bp, Homo sapiens
aagcagcgagagaagct

SEQ ID NO: 6858 - DNA, 17 bp, Homo sapiens
agcagcgagagaagctg

SEQ ID NO: 6859 - DNA, 17 bp, Homo sapiens
gcagcgagagaagctgg

SEQ ID NO: 6860 - DNA, 17 bp, Homo sapiens
cagcgagagaagctggt

SEQ ID NO: 6861 - DNA, 17 bp, Homo sapiens
agcgagagaagctggta

SEQ ID NO: 6862 - DNA, 17 bp, Homo sapiens
gcgagagaagctggtat

SEQ ID NO: 6863 - DNA, 17 bp, Homo sapiens
cgagagaagctggtatc

SEQ ID NO: 6864 - DNA, 17 bp, Homo sapiens
gagagaagctggtatct

SEQ ID NO: 6865 - DNA, 17 bp, Homo sapiens
agagaagctggtatctc

SEQ ID NO: 6866 - DNA, 17 bp, Homo sapiens
gagaagctggtatctca

SEQ ID NO: 6867 - DNA, 17 bp, Homo sapiens
agaagctggtatctcag

SEQ ID NO: 6868 - DNA, 17 bp, Homo sapiens
gaagctggtatctcaga

SEQ ID NO: 6869 - DNA, 17 bp, Homo sapiens
aagctggtatctcagag

SEQ ID NO: 6870 - DNA, 17 bp, Homo sapiens
agctggtatctcagagc

SEQ ID NO: 6871 - DNA, 17 bp, Homo sapiens
gctggtatctcagagca

SEQ ID NO: 6872 - DNA, 17 bp, Homo sapiens
ctggtatctcagagcat

SEQ ID NO: 6873 - DNA, 17 bp, Homo sapiens
tggtatctcagagcatc

SEQ ID NO: 6874 - DNA, 17 bp, Homo sapiens
ggtatctcagagcatcg

SEQ ID NO: 6875 - DNA, 17 bp, Homo sapiens
gtatctcagagcatcgt

SEQ ID NO: 6876 - DNA, 17 bp, Homo sapiens
tatctcagagcatcgtt

SEQ ID NO: 6877 - DNA, 17 bp, Homo sapiens
atctcagagcatcgttc

SEQ ID NO: 6878 - DNA, 17 bp, Homo sapiens
tctcagagcatcgttct

SEQ ID NO: 6879 - DNA, 17 bp, Homo sapiens
ctcagagcatcgttctc

SEQ ID NO: 6880 - DNA, 17 bp, Homo sapiens
tcagagcatcgttctct

SEQ ID NO: 6881 - DNA, 17 bp, Homo sapiens
cagagcatcgttctctt

SEQ ID NO: 6882 - DNA, 17 bp, Homo sapiens
agagcatcgttctcttc

SEQ ID NO: 6883 - DNA, 17 bp, Homo sapiens
gagcatcgttctcttcc

SEQ ID NO: 6884 - DNA, 17 bp, Homo sapiens
agcatcgttctcttcca

SEQ ID NO: 6885 - DNA, 17 bp, Homo sapiens
gcatcgttctcttccag

SEQ ID NO: 6886 - DNA, 17 bp, Homo sapiens
catcgttctcttccagg

SEQ ID NO: 6887 - DNA, 17 bp, Homo sapiens
atcgttctcttccaggc

SEQ ID NO: 6888 - DNA, 17 bp, Homo sapiens
tcgttctcttccaggcg

SEQ ID NO: 6889 - DNA, 17 bp, Homo sapiens
cgttctcttccaggcgg

SEQ ID NO: 6890 - DNA, 17 bp, Homo sapiens
gttctcttccaggcggc

SEQ ID NO: 6891 - DNA, 17 bp, Homo sapiens
ttctcttccaggcggct

SEQ ID NO: 6892 - DNA, 17 bp, Homo sapiens
tctcttccaggcggctt

SEQ ID NO: 6893 - DNA, 17 bp, Homo sapiens
ctcttccaggcggcttg

SEQ ID NO: 6894 - DNA, 17 bp, Homo sapiens
tcttccaggcggcttgc

SEQ ID NO: 6895 - DNA, 17 bp, Homo sapiens
cttccaggcggcttgca

SEQ ID NO: 6896 - DNA, 17 bp, Homo sapiens
ttccaggcggcttgcaa

SEQ ID NO: 6897 - DNA, 17 bp, Homo sapiens
tccaggcggcttgcaag

SEQ ID NO: 6898 - DNA, 17 bp, Homo sapiens
ccaggcggcttgcaagg

SEQ ID NO: 6899 - DNA, 17 bp, Homo sapiens
caggcggcttgcaaggg

SEQ ID NO: 6900 - DNA, 17 bp, Homo sapiens
aggcggcttgcaagggc

SEQ ID NO: 6901 - DNA, 17 bp, Homo sapiens
ggcggcttgcaagggct

SEQ ID NO: 6902 - DNA, 17 bp, Homo sapiens
gcggcttgcaagggctt

SEQ ID NO: 6903 - DNA, 17 bp, Homo sapiens
cggcttgcaagggcttt

SEQ ID NO: 6904 - DNA, 17 bp, Homo sapiens
ggcttgcaagggctttc

SEQ ID NO: 6905 - DNA, 17 bp, Homo sapiens
gcttgcaagggctttct

SEQ ID NO: 6906 - DNA, 17 bp, Homo sapiens
cttgcaagggctttctg

SEQ ID NO: 6907 - DNA, 17 bp, Homo sapiens
ttgcaagggctttctgt

SEQ ID NO: 6908 - DNA, 17 bp, Homo sapiens
tgcaagggctttctgtc

SEQ ID NO: 6909 - DNA, 17 bp, Homo sapiens
gcaagggctttctgtct

SEQ ID NO: 6910 - DNA, 17 bp, Homo sapiens
caagggctttctgtctc

SEQ ID NO: 6911 - DNA, 17 bp, Homo sapiens
aagggctttctgtctcg

SEQ ID NO: 6912 - DNA, 17 bp, Homo sapiens
agggctttctgtctcgc

SEQ ID NO: 6913 - DNA, 17 bp, Homo sapiens
gggctttctgtctcgcc

SEQ ID NO: 6914 - DNA, 17 bp, Homo sapiens
ggctttctgtctcgcca

SEQ ID NO: 6915 - DNA, 17 bp, Homo sapiens
gctttctgtctcgccag

SEQ ID NO: 6916 - DNA, 17 bp, Homo sapiens
ctttctgtctcgccagg

SEQ ID NO: 6917 - DNA, 17 bp, Homo sapiens
tttctgtctcgccagga

SEQ ID NO: 6918 - DNA, 17 bp, Homo sapiens
ttctgtctcgccaggaa

SEQ ID NO: 6919 - DNA, 17 bp, Homo sapiens
tctgtctcgccaggaat

SEQ ID NO: 6920 - DNA, 17 bp, Homo sapiens
ctgtctcgccaggaatt

SEQ ID NO: 6921 - DNA, 17 bp, Homo sapiens
tgtctcgccaggaattc

SEQ ID NO: 6922 - DNA, 17 bp, Homo sapiens
gtctcgccaggaattca

SEQ ID NO: 6923 - DNA, 17 bp, Homo sapiens
tctcgccaggaattcaa

SEQ ID NO: 6924 - DNA, 17 bp, Homo sapiens
ctcgccaggaattcaag

SEQ ID NO: 6925 - DNA, 17 bp, Homo sapiens
tcgccaggaattcaaga

SEQ ID NO: 6926 - DNA, 17 bp, Homo sapiens
cgccaggaattcaagaa

SEQ ID NO: 6927 - DNA, 17 bp, Homo sapiens
gccaggaattcaagaag

SEQ ID NO: 6928 - DNA, 17 bp, Homo sapiens
ccaggaattcaagaagc

SEQ ID NO: 6929 - DNA, 17 bp, Homo sapiens
caggaattcaagaagct

SEQ ID NO: 6930 - DNA, 17 bp, Homo sapiens
aggaattcaagaagctg

SEQ ID NO: 6931 - DNA, 17 bp, Homo sapiens
ggaattcaagaagctga

SEQ ID NO: 6932 - DNA, 17 bp, Homo sapiens
gaattcaagaagctgaa

SEQ ID NO: 6933 - DNA, 17 bp, Homo sapiens
aattcaagaagctgaag

SEQ ID NO: 6934 - DNA, 17 bp, Homo sapiens
attcaagaagctgaaga

SEQ ID NO: 6935 - DNA, 17 bp, Homo sapiens
ttcaagaagctgaagat

SEQ ID NO: 6936 - DNA, 17 bp, Homo sapiens
tcaagaagctgaagatt

SEQ ID NO: 6937 - DNA, 17 bp, Homo sapiens
caagaagctgaagattc

SEQ ID NO: 6938 - DNA, 17 bp, Homo sapiens
aagaagctgaagattcg

SEQ ID NO: 6939 - DNA, 17 bp, Homo sapiens
agaagctgaagattcgc

SEQ ID NO: 6940 - DNA, 17 bp, Homo sapiens
gaagctgaagattcgcc

SEQ ID NO: 6941 - DNA, 17 bp, Homo sapiens
aagctgaagattcgccg

SEQ ID NO: 6942 - DNA, 17 bp, Homo sapiens
agctgaagattcgccga

SEQ ID NO: 6943 - DNA, 17 bp, Homo sapiens
gctgaagattcgccgac

SEQ ID NO: 6944 - DNA, 17 bp, Homo sapiens
ctgaagattcgccgact

SEQ ID NO: 6945 - DNA, 17 bp, Homo sapiens
tgaagattcgccgactg

SEQ ID NO: 6946 - DNA, 17 bp, Homo sapiens
gaagattcgccgactgg

SEQ ID NO: 6947 - DNA, 17 bp, Homo sapiens
aagattcgccgactggc

SEQ ID NO: 6948 - DNA, 17 bp, Homo sapiens
agattcgccgactggct

SEQ ID NO: 6949 - DNA, 17 bp, Homo sapiens
gattcgccgactggctg

SEQ ID NO: 6950 - DNA, 17 bp, Homo sapiens
attcgccgactggctgc

SEQ ID NO: 6951 - DNA, 17 bp, Homo sapiens
ttcgccgactggctgca

SEQ ID NO: 6952 - DNA, 17 bp, Homo sapiens
tcgccgactggctgcac

SEQ ID NO: 6953 - DNA, 17 bp, Homo sapiens
cgccgactggctgcaca

SEQ ID NO: 6954 - DNA, 17 bp, Homo sapiens
gccgactggctgcacag

SEQ ID NO: 6955 - DNA, 17 bp, Homo sapiens
ccgactggctgcacagt

SEQ ID NO: 6956 - DNA, 17 bp, Homo sapiens
cgactggctgcacagtg

SEQ ID NO: 6957 - DNA, 17 bp, Homo sapiens
gactggctgcacagtgc

SEQ ID NO: 6958 - DNA, 17 bp, Homo sapiens
actggctgcacagtgca

SEQ ID NO: 6959 - DNA, 17 bp, Homo sapiens
ctggctgcacagtgcat

SEQ ID NO: 6960 - DNA, 17 bp, Homo sapiens
tggctgcacagtgcatc

SEQ ID NO: 6961 - DNA, 17 bp, Homo sapiens
ggctgcacagtgcatcc

SEQ ID NO: 6962 - DNA, 17 bp, Homo sapiens
gctgcacagtgcatcca

SEQ ID NO: 6963 - DNA, 17 bp, Homo sapiens
ctgcacagtgcatccag

SEQ ID NO: 6964 - DNA, 17 bp, Homo sapiens
tgcacagtgcatccaga

SEQ ID NO: 6965 - DNA, 17 bp, Homo sapiens
gcacagtgcatccagaa

SEQ ID NO: 6966 - DNA, 17 bp, Homo sapiens
cacagtgcatccagaag

SEQ ID NO: 6967 - DNA, 17 bp, Homo sapiens
acagtgcatccagaaga

SEQ ID NO: 6968 - DNA, 17 bp, Homo sapiens
cagtgcatccagaagaa

SEQ ID NO: 6969 - DNA, 17 bp, Homo sapiens
agtgcatccagaagaat

SEQ ID NO: 6970 - DNA, 17 bp, Homo sapiens
gtgcatccagaagaatg

SEQ ID NO: 6971 - DNA, 17 bp, Homo sapiens
tgcatccagaagaatgt

SEQ ID NO: 6972 - DNA, 17 bp, Homo sapiens
gcatccagaagaatgtg

SEQ ID NO: 6973 - DNA, 17 bp, Homo sapiens
catccagaagaatgtgg

SEQ ID NO: 6974 - DNA, 17 bp, Homo sapiens
atccagaagaatgtggc

SEQ ID NO: 6975 - DNA, 17 bp, Homo sapiens
tccagaagaatgtggct

SEQ ID NO: 6976 - DNA, 17 bp, Homo sapiens
ccagaagaatgtggctg

SEQ ID NO: 6977 - DNA, 17 bp, Homo sapiens
cagaagaatgtggctgt

SEQ ID NO: 6978 - DNA, 17 bp, Homo sapiens
agaagaatgtggctgtg

SEQ ID NO: 6979 - DNA, 17 bp, Homo sapiens
gaagaatgtggctgtgt

SEQ ID NO: 6980 - DNA, 17 bp, Homo sapiens
aagaatgtggctgtgtt

SEQ ID NO: 6981 - DNA, 17 bp, Homo sapiens
agaatgtggctgtgttc

SEQ ID NO: 6982 - DNA, 17 bp, Homo sapiens
gaatgtggctgtgttcc

SEQ ID NO: 6983 - DNA, 17 bp, Homo sapiens
aatgtggctgtgttcct

SEQ ID NO: 6984 - DNA, 17 bp, Homo sapiens
atgtggctgtgttcctc

SEQ ID NO: 6985 - DNA, 17 bp, Homo sapiens
tgtggctgtgttcctcg

SEQ ID NO: 6986 - DNA, 17 bp, Homo sapiens
gtggctgtgttcctcgc

SEQ ID NO: 6987 - DNA, 17 bp, Homo sapiens
tggctgtgttcctcgca

SEQ ID NO: 6988 - DNA, 17 bp, Homo sapiens
ggctgtgttcctcgcag

SEQ ID NO: 6989 - DNA, 17 bp, Homo sapiens
gctgtgttcctcgcagt

SEQ ID NO: 6990 - DNA, 17 bp, Homo sapiens
ctgtgttcctcgcagtc

SEQ ID NO: 6991 - DNA, 17 bp, Homo sapiens
tgtgttcctcgcagtca

SEQ ID NO: 6992 - DNA, 17 bp, Homo sapiens
gtgttcctcgcagtcaa

SEQ ID NO: 6993 - DNA, 17 bp, Homo sapiens
tgttcctcgcagtcaag

SEQ ID NO: 6994 - DNA, 17 bp, Homo sapiens
gttcctcgcagtcaagg

SEQ ID NO: 6995 - DNA, 17 bp, Homo sapiens
ttcctcgcagtcaagga

SEQ ID NO: 6996 - DNA, 17 bp, Homo sapiens
tcctcgcagtcaaggac

SEQ ID NO: 6997 - DNA, 17 bp, Homo sapiens
cctcgcagtcaaggact

SEQ ID NO: 6998 - DNA, 17 bp, Homo sapiens
ctcgcagtcaaggactg

SEQ ID NO: 6999 - DNA, 17 bp, Homo sapiens
tcgcagtcaaggactgg

SEQ ID NO: 7000 - DNA, 17 bp, Homo sapiens
cgcagtcaaggactggc

SEQ ID NO: 7001 - DNA, 17 bp, Homo sapiens
gcagtcaaggactggcc

SEQ ID NO: 7002 - DNA, 17 bp, Homo sapiens
cagtcaaggactggcca

SEQ ID NO: 7003 - DNA, 17 bp, Homo sapiens
agtcaaggactggccat

SEQ ID NO: 7004 - DNA, 17 bp, Homo sapiens
gtcaaggactggccatg

SEQ ID NO: 7005 - DNA, 17 bp, Homo sapiens
tcaaggactggccatgg

SEQ ID NO: 7006 - DNA, 17 bp, Homo sapiens
caaggactggccatggt

SEQ ID NO: 7007 - DNA, 17 bp, Homo sapiens
aaggactggccatggtg

SEQ ID NO: 7008 - DNA, 17 bp, Homo sapiens
aggactggccatggtgg

SEQ ID NO: 7009 - DNA, 17 bp, Homo sapiens
ggactggccatggtggc

SEQ ID NO: 7010 - DNA, 17 bp, Homo sapiens
gactggccatggtggca

SEQ ID NO: 7011 - DNA, 17 bp, Homo sapiens
actggccatggtggcag

SEQ ID NO: 7012 - DNA, 17 bp, Homo sapiens
ctggccatggtggcagc

SEQ ID NO: 7013 - DNA, 17 bp, Homo sapiens
tggccatggtggcagct

SEQ ID NO: 7014 - DNA, 17 bp, Homo sapiens
ggccatggtggcagctg

SEQ ID NO: 7015 - DNA, 17 bp, Homo sapiens
gccatggtggcagctgc

SEQ ID NO: 7016 - DNA, 17 bp, Homo sapiens
ccatggtggcagctgct

SEQ ID NO: 7017 - DNA, 17 bp, Homo sapiens
catggtggcagctgctt

SEQ ID NO: 7018 - DNA, 17 bp, Homo sapiens
atggtggcagctgcttg

SEQ ID NO: 7019 - DNA, 17 bp, Homo sapiens
tggtggcagctgcttgg

SEQ ID NO: 7020 - DNA, 17 bp, Homo sapiens
ggtggcagctgcttggt

SEQ ID NO: 7021 - DNA, 17 bp, Homo sapiens
gtggcagctgcttggtt

SEQ ID NO: 7022 - DNA, 17 bp, Homo sapiens
tggcagctgcttggttc

SEQ ID NO: 7023 - DNA, 17 bp, Homo sapiens
ggcagctgcttggttcc

SEQ ID NO: 7024 - DNA, 17 bp, Homo sapiens
gcagctgcttggttccc

SEQ ID NO: 7025 - DNA, 17 bp, Homo sapiens
cagctgcttggttccct

SEQ ID NO: 7026 - DNA, 17 bp, Homo sapiens
agctgcttggttccctc

SEQ ID NO: 7027 - DNA, 17 bp, Homo sapiens
gctgcttggttccctcc

SEQ ID NO: 7028 - DNA, 17 bp, Homo sapiens
ctgcttggttccctcca

SEQ ID NO: 7029 - DNA, 17 bp, Homo sapiens
tgcttggttccctccag

SEQ ID NO: 7030 - DNA, 17 bp, Homo sapiens
gcttggttccctccagc

SEQ ID NO: 7031 - DNA, 17 bp, Homo sapiens
cttggttccctccagcc

SEQ ID NO: 7032 - DNA, 17 bp, Homo sapiens
ttggttccctccagcct

SEQ ID NO: 7033 - DNA, 17 bp, Homo sapiens
tggttccctccagcctc

SEQ ID NO: 7034 - DNA, 17 bp, Homo sapiens
ggttccctccagcctct

SEQ ID NO: 7035 - DNA, 17 bp, Homo sapiens
gttccctccagcctcta

SEQ ID NO: 7036 - DNA, 17 bp, Homo sapiens
ttccctccagcctctac

SEQ ID NO: 7037 - DNA, 17 bp, Homo sapiens
tccctccagcctctact

SEQ ID NO: 7038 - DNA, 17 bp, Homo sapiens
ccctccagcctctactt

SEQ ID NO: 7039 - DNA, 17 bp, Homo sapiens
cctccagcctctactta

SEQ ID NO: 7040 - DNA, 17 bp, Homo sapiens
ctccagcctctacttag

SEQ ID NO: 7041 - DNA, 17 bp, Homo sapiens
tccagcctctacttagt

SEQ ID NO: 7042 - DNA, 17 bp, Homo sapiens
ccagcctctacttagtg

SEQ ID NO: 7043 - DNA, 17 bp, Homo sapiens
cagcctctacttagtgc

SEQ ID NO: 7044 - DNA, 17 bp, Homo sapiens
agcctctacttagtgcc

SEQ ID NO: 7045 - DNA, 17 bp, Homo sapiens
gcctctacttagtgcca

SEQ ID NO: 7046 - DNA, 17 bp, Homo sapiens
cctctacttagtgccac

SEQ ID NO: 7047 - DNA, 17 bp, Homo sapiens
ctctacttagtgccacc

SEQ ID NO: 7048 - DNA, 17 bp, Homo sapiens
tctacttagtgccacca

SEQ ID NO: 7049 - DNA, 17 bp, Homo sapiens
ctacttagtgccaccat

SEQ ID NO: 7050 - DNA, 17 bp, Homo sapiens
tacttagtgccaccatt

SEQ ID NO: 7051 - DNA, 17 bp, Homo sapiens
acttagtgccaccattg

SEQ ID NO: 7052 - DNA, 17 bp, Homo sapiens
cttagtgccaccattgg

SEQ ID NO: 7053 - DNA, 17 bp, Homo sapiens
ttagtgccaccattgga

SEQ ID NO: 7054 - DNA, 17 bp, Homo sapiens
tagtgccaccattggaa

SEQ ID NO: 7055 - DNA, 17 bp, Homo sapiens
agtgccaccattggaac

SEQ ID NO: 7056 - DNA, 17 bp, Homo sapiens
gtgccaccattggaact

SEQ ID NO: 7057 - DNA, 17 bp, Homo sapiens
tgccaccattggaactg

SEQ ID NO: 7058 - DNA, 17 bp, Homo sapiens
gccaccattggaactga

SEQ ID NO: 7059 - DNA, 17 bp, Homo sapiens
ccaccattggaactgag

SEQ ID NO: 7060 - DNA, 17 bp, Homo sapiens
caccattggaactgagc

SEQ ID NO: 7061 - DNA, 17 bp, Homo sapiens
accattggaactgagca

SEQ ID NO: 7062 - DNA, 17 bp, Homo sapiens
ccattggaactgagcag

SEQ ID NO: 7063 - DNA, 17 bp, Homo sapiens
cattggaactgagcagc

SEQ ID NO: 7064 - DNA, 17 bp, Homo sapiens
attggaactgagcagct

SEQ ID NO: 7065 - DNA, 17 bp, Homo sapiens
ttggaactgagcagctc

SEQ ID NO: 7066 - DNA, 17 bp, Homo sapiens
tggaactgagcagctcc

SEQ ID NO: 7067 - DNA, 17 bp, Homo sapiens
ggaactgagcagctccg

SEQ ID NO: 7068 - DNA, 17 bp, Homo sapiens
gaactgagcagctccga

SEQ ID NO: 7069 - DNA, 17 bp, Homo sapiens
aactgagcagctccgag

SEQ ID NO: 7070 - DNA, 17 bp, Homo sapiens
actgagcagctccgagc

SEQ ID NO: 7071 - DNA, 17 bp, Homo sapiens
ctgagcagctccgagcc

SEQ ID NO: 7072 - DNA, 17 bp, Homo sapiens
tgagcagctccgagcca

SEQ ID NO: 7073 - DNA, 17 bp, Homo sapiens
gagcagctccgagccaa

SEQ ID NO: 7074 - DNA, 17 bp, Homo sapiens
agcagctccgagccaag

SEQ ID NO: 7075 - DNA, 17 bp, Homo sapiens
gcagctccgagccaagg

SEQ ID NO: 7076 - DNA, 17 bp, Homo sapiens
cagctccgagccaagga

SEQ ID NO: 7077 - DNA, 17 bp, Homo sapiens
agctccgagccaaggag

SEQ ID NO: 7078 - DNA, 17 bp, Homo sapiens
gctccgagccaaggagg

SEQ ID NO: 7079 - DNA, 17 bp, Homo sapiens
ctccgagccaaggagga

SEQ ID NO: 7080 - DNA, 17 bp, Homo sapiens
tccgagccaaggaggag

SEQ ID NO: 7081 - DNA, 17 bp, Homo sapiens
ccgagccaaggaggagg

SEQ ID NO: 7082 - DNA, 17 bp, Homo sapiens
cgagccaaggaggagga

SEQ ID NO: 7083 - DNA, 17 bp, Homo sapiens
gagccaaggaggaggag

SEQ ID NO: 7084 - DNA, 17 bp, Homo sapiens
agccaaggaggaggagc

SEQ ID NO: 7085 - DNA, 17 bp, Homo sapiens
gccaaggaggaggagct

SEQ ID NO: 7086 - DNA, 17 bp, Homo sapiens
ccaaggaggaggagctt

SEQ ID NO: 7087 - DNA, 17 bp, Homo sapiens
caaggaggaggagctta

SEQ ID NO: 7088 - DNA, 17 bp, Homo sapiens
aaggaggaggagcttac

SEQ ID NO: 7089 - DNA, 17 bp, Homo sapiens
aggaggaggagcttaca

SEQ ID NO: 7090 - DNA, 17 bp, Homo sapiens
ggaggaggagcttacaa

SEQ ID NO: 7091 - DNA, 17 bp, Homo sapiens
gaggaggagcttacaac

SEQ ID NO: 7092 - DNA, 17 bp, Homo sapiens
aggaggagcttacaacg

SEQ ID NO: 7093 - DNA, 17 bp, Homo sapiens
ggaggagcttacaacgc

SEQ ID NO: 7094 - DNA, 17 bp, Homo sapiens
gaggagcttacaacgct

SEQ ID NO: 7095 - DNA, 17 bp, Homo sapiens
aggagcttacaacgcta

SEQ ID NO: 7096 - DNA, 17 bp, Homo sapiens
ggagcttacaacgctaa

SEQ ID NO: 7097 - DNA, 17 bp, Homo sapiens
gagcttacaacgctaag

SEQ ID NO: 7098 - DNA, 17 bp, Homo sapiens
agcttacaacgctaaga

SEQ ID NO: 7099 - DNA, 17 bp, Homo sapiens
gcttacaacgctaagac

SEQ ID NO: 7100 - DNA, 17 bp, Homo sapiens
cttacaacgctaagacg

SEQ ID NO: 7101 - DNA, 17 bp, Homo sapiens
ttacaacgctaagacgg

SEQ ID NO: 7102 - DNA, 17 bp, Homo sapiens
tacaacgctaagacgga

SEQ ID NO: 7103 - DNA, 17 bp, Homo sapiens
acaacgctaagacggaa

SEQ ID NO: 7104 - DNA, 17 bp, Homo sapiens
caacgctaagacggaag

SEQ ID NO: 7105 - DNA, 17 bp, Homo sapiens
aacgctaagacggaagc

SEQ ID NO: 7106 - DNA, 17 bp, Homo sapiens
acgctaagacggaagct

SEQ ID NO: 7107 - DNA, 17 bp, Homo sapiens
cgctaagacggaagcta

SEQ ID NO: 7108 - DNA, 17 bp, Homo sapiens
gctaagacggaagctag

SEQ ID NO: 7109 - DNA, 17 bp, Homo sapiens
ctaagacggaagctaga

SEQ ID NO: 7110 - DNA, 17 bp, Homo sapiens
taagacggaagctagaa

SEQ ID NO: 7111 - DNA, 17 bp, Homo sapiens
aagacggaagctagaaa

SEQ ID NO: 7112 - DNA, 17 bp, Homo sapiens
agacggaagctagaaaa

SEQ ID NO: 7113 - DNA, 17 bp, Homo sapiens
gacggaagctagaaaaa

SEQ ID NO: 7114 - DNA, 17 bp, Homo sapiens
acggaagctagaaaaat

SEQ ID NO: 7115 - DNA, 17 bp, Homo sapiens
cggaagctagaaaaatc

SEQ ID NO: 7116 - DNA, 17 bp, Homo sapiens
ggaagctagaaaaatca

SEQ ID NO: 7117 - DNA, 17 bp, Homo sapiens
gaagctagaaaaatcag

SEQ ID NO: 7118 - DNA, 17 bp, Homo sapiens
aagctagaaaaatcaga

SEQ ID NO: 7119 - DNA, 17 bp, Homo sapiens
agctagaaaaatcagag

SEQ ID NO: 7120 - DNA, 17 bp, Homo sapiens
gctagaaaaatcagaga

SEQ ID NO: 7121 - DNA, 17 bp, Homo sapiens
ctagaaaaatcagagaa

SEQ ID NO: 7122 - DNA, 17 bp, Homo sapiens
tagaaaaatcagagaag

SEQ ID NO: 7123 - DNA, 17 bp, Homo sapiens
agaaaaatcagagaagt

SEQ ID NO: 7124 - DNA, 17 bp, Homo sapiens
gaaaaatcagagaagtt

SEQ ID NO: 7125 - DNA, 17 bp, Homo sapiens
aaaaatcagagaagttg

SEQ ID NO: 7126 - DNA, 17 bp, Homo sapiens
aaaatcagagaagttgc

SEQ ID NO: 7127 - DNA, 17 bp, Homo sapiens
aaatcagagaagttgcg

SEQ ID NO: 7128 - DNA, 17 bp, Homo sapiens
aatcagagaagttgcgg

SEQ ID NO: 7129 - DNA, 17 bp, Homo sapiens
atcagagaagttgcgga

SEQ ID NO: 7130 - DNA, 17 bp, Homo sapiens
tcagagaagttgcggaa

SEQ ID NO: 7131 - DNA, 17 bp, Homo sapiens
cagagaagttgcggaat

SEQ ID NO: 7132 - DNA, 17 bp, Homo sapiens
agagaagttgcggaatg

SEQ ID NO: 7133 - DNA, 17 bp, Homo sapiens
gagaagttgcggaatga

SEQ ID NO: 7134 - DNA, 17 bp, Homo sapiens
agaagttgcggaatgaa

SEQ ID NO: 7135 - DNA, 17 bp, Homo sapiens
gaagttgcggaatgaac

SEQ ID NO: 7136 - DNA, 17 bp, Homo sapiens
aagttgcggaatgaact

SEQ ID NO: 7137 - DNA, 17 bp, Homo sapiens
agttgcggaatgaactc

SEQ ID NO: 7138 - DNA, 17 bp, Homo sapiens
gttgcggaatgaactcc

SEQ ID NO: 7139 - DNA, 17 bp, Homo sapiens
ttgcggaatgaactccg

SEQ ID NO: 7140 - DNA, 17 bp, Homo sapiens
tgcggaatgaactccgg

SEQ ID NO: 7141 - DNA, 17 bp, Homo sapiens
gcggaatgaactccggc

SEQ ID NO: 7142 - DNA, 17 bp, Homo sapiens
cggaatgaactccggca

SEQ ID NO: 7143 - DNA, 17 bp, Homo sapiens
ggaatgaactccggcag

SEQ ID NO: 7144 - DNA, 17 bp, Homo sapiens
gaatgaactccggcaga

SEQ ID NO: 7145 - DNA, 17 bp, Homo sapiens
aatgaactccggcagaa

SEQ ID NO: 7146 - DNA, 17 bp, Homo sapiens
atgaactccggcagaac

SEQ ID NO: 7147 - DNA, 17 bp, Homo sapiens
tgaactccggcagaaca

SEQ ID NO: 7148 - DNA, 17 bp, Homo sapiens
gaactccggcagaacac

SEQ ID NO: 7149 - DNA, 17 bp, Homo sapiens
aactccggcagaacaca

SEQ ID NO: 7150 - DNA, 17 bp, Homo sapiens
actccggcagaacacag

SEQ ID NO: 7151 - DNA, 17 bp, Homo sapiens
ctccggcagaacacaga

SEQ ID NO: 7152 - DNA, 17 bp, Homo sapiens
tccggcagaacacagat

SEQ ID NO: 7153 - DNA, 17 bp, Homo sapiens
ccggcagaacacagatc

SEQ ID NO: 7154 - DNA, 17 bp, Homo sapiens
cggcagaacacagatct

SEQ ID NO: 7155 - DNA, 17 bp, Homo sapiens
ggcagaacacagatctg

SEQ ID NO: 7156 - DNA, 17 bp, Homo sapiens
gcagaacacagatctgc

SEQ ID NO: 7157 - DNA, 17 bp, Homo sapiens
cagaacacagatctgct

SEQ ID NO: 7158 - DNA, 17 bp, Homo sapiens
agaacacagatctgcta

SEQ ID NO: 7159 - DNA, 17 bp, Homo sapiens
gaacacagatctgctag

SEQ ID NO: 7160 - DNA, 17 bp, Homo sapiens
aacacagatctgctaga

SEQ ID NO: 7161 - DNA, 17 bp, Homo sapiens
acacagatctgctagaa

SEQ ID NO: 7162 - DNA, 17 bp, Homo sapiens
cacagatctgctagaaa

SEQ ID NO: 7163 - DNA, 17 bp, Homo sapiens
acagatctgctagaaag

SEQ ID NO: 7164 - DNA, 17 bp, Homo sapiens
cagatctgctagaaagc

SEQ ID NO: 7165 - DNA, 17 bp, Homo sapiens
agatctgctagaaagca

SEQ ID NO: 7166 - DNA, 17 bp, Homo sapiens
gatctgctagaaagcaa

SEQ ID NO: 7167 - DNA, 17 bp, Homo sapiens
atctgctagaaagcaag

SEQ ID NO: 7168 - DNA, 17 bp, Homo sapiens
tctgctagaaagcaaga

SEQ ID NO: 7169 - DNA, 17 bp, Homo sapiens
ctgctagaaagcaagat

SEQ ID NO: 7170 - DNA, 17 bp, Homo sapiens
tgctagaaagcaagatt

SEQ ID NO: 7171 - DNA, 17 bp, Homo sapiens
gctagaaagcaagattg

SEQ ID NO: 7172 - DNA, 17 bp, Homo sapiens
ctagaaagcaagattgc

SEQ ID NO: 7173 - DNA, 17 bp, Homo sapiens
tagaaagcaagattgct

SEQ ID NO: 7174 - DNA, 17 bp, Homo sapiens
agaaagcaagattgctg

SEQ ID NO: 7175 - DNA, 17 bp, Homo sapiens
gaaagcaagattgctga

SEQ ID NO: 7176 - DNA, 17 bp, Homo sapiens
aaagcaagattgctgac

SEQ ID NO: 7177 - DNA, 17 bp, Homo sapiens
aagcaagattgctgact

SEQ ID NO: 7178 - DNA, 17 bp, Homo sapiens
agcaagattgctgactt

SEQ ID NO: 7179 - DNA, 17 bp, Homo sapiens
gcaagattgctgacttg

SEQ ID NO: 7180 - DNA, 17 bp, Homo sapiens
caagattgctgacttga

SEQ ID NO: 7181 - DNA, 17 bp, Homo sapiens
aagattgctgacttgac

SEQ ID NO: 7182 - DNA, 17 bp, Homo sapiens
agattgctgacttgacc

SEQ ID NO: 7183 - DNA, 17 bp, Homo sapiens
gattgctgacttgacct

SEQ ID NO: 7184 - DNA, 17 bp, Homo sapiens
attgctgacttgacctc

SEQ ID NO: 7185 - DNA, 17 bp, Homo sapiens
ttgctgacttgacctct

SEQ ID NO: 7186 - DNA, 17 bp, Homo sapiens
tgctgacttgacctctg

SEQ ID NO: 7187 - DNA, 17 bp, Homo sapiens
gctgacttgacctctga

SEQ ID NO: 7188 - DNA, 17 bp, Homo sapiens
ctgacttgacctctgac

SEQ ID NO: 7189 - DNA, 17 bp, Homo sapiens
tgacttgacctctgacc

SEQ ID NO: 7190 - DNA, 17 bp, Homo sapiens
gacttgacctctgacct

SEQ ID NO: 7191 - DNA, 17 bp, Homo sapiens
acttgacctctgacctt

SEQ ID NO: 7192 - DNA, 17 bp, Homo sapiens
cttgacctctgaccttg

SEQ ID NO: 7193 - DNA, 17 bp, Homo sapiens
ttgacctctgaccttgc

SEQ ID NO: 7194 - DNA, 17 bp, Homo sapiens
tgacctctgaccttgcc

SEQ ID NO: 7195 - DNA, 17 bp, Homo sapiens
gacctctgaccttgccg

SEQ ID NO: 7196 - DNA, 17 bp, Homo sapiens
acctctgaccttgccga

SEQ ID NO: 7197 - DNA, 17 bp, Homo sapiens
cctctgaccttgccgat

SEQ ID NO: 7198 - DNA, 17 bp, Homo sapiens
ctctgaccttgccgatg

SEQ ID NO: 7199 - DNA, 17 bp, Homo sapiens
tctgaccttgccgatga

SEQ ID NO: 7200 - DNA, 17 bp, Homo sapiens
ctgaccttgccgatgag

SEQ ID NO: 7201 - DNA, 17 bp, Homo sapiens
tgaccttgccgatgagc

SEQ ID NO: 7202 - DNA, 17 bp, Homo sapiens
gaccttgccgatgagcg

SEQ ID NO: 7203 - DNA, 17 bp, Homo sapiens
accttgccgatgagcgc

SEQ ID NO: 7204 - DNA, 17 bp, Homo sapiens
ccttgccgatgagcgct

SEQ ID NO: 7205 - DNA, 17 bp, Homo sapiens
cttgccgatgagcgctt

SEQ ID NO: 7206 - DNA, 17 bp, Homo sapiens
ttgccgatgagcgcttc

SEQ ID NO: 7207 - DNA, 17 bp, Homo sapiens
tgccgatgagcgcttca

SEQ ID NO: 7208 - DNA, 17 bp, Homo sapiens
gccgatgagcgcttcaa

SEQ ID NO: 7209 - DNA, 17 bp, Homo sapiens
ccgatgagcgcttcaaa

SEQ ID NO: 7210 - DNA, 17 bp, Homo sapiens
cgatgagcgcttcaaag

SEQ ID NO: 7211 - DNA, 17 bp, Homo sapiens
gatgagcgcttcaaagg

SEQ ID NO: 7212 - DNA, 17 bp, Homo sapiens
atgagcgcttcaaaggt

SEQ ID NO: 7213 - DNA, 17 bp, Homo sapiens
tgagcgcttcaaaggtg

SEQ ID NO: 7214 - DNA, 17 bp, Homo sapiens
gagcgcttcaaaggtga

SEQ ID NO: 7215 - DNA, 17 bp, Homo sapiens
agcgcttcaaaggtgat

SEQ ID NO: 7216 - DNA, 17 bp, Homo sapiens
gcgcttcaaaggtgatg

SEQ ID NO: 7217 - DNA, 17 bp, Homo sapiens
cgcttcaaaggtgatgt

SEQ ID NO: 7218 - DNA, 17 bp, Homo sapiens
gcttcaaaggtgatgtg

SEQ ID NO: 7219 - DNA, 17 bp, Homo sapiens
cttcaaaggtgatgtgg

SEQ ID NO: 7220 - DNA, 17 bp, Homo sapiens
ttcaaaggtgatgtggc

SEQ ID NO: 7221 - DNA, 17 bp, Homo sapiens
tcaaaggtgatgtggcc

SEQ ID NO: 7222 - DNA, 17 bp, Homo sapiens
caaaggtgatgtggcct

SEQ ID NO: 7223 - DNA, 17 bp, Homo sapiens
aaaggtgatgtggcctg

SEQ ID NO: 7224 - DNA, 17 bp, Homo sapiens
aaggtgatgtggcctgc

SEQ ID NO: 7225 - DNA, 17 bp, Homo sapiens
aggtgatgtggcctgcc

SEQ ID NO: 7226 - DNA, 17 bp, Homo sapiens
ggtgatgtggcctgcca

SEQ ID NO: 7227 - DNA, 17 bp, Homo sapiens
gtgatgtggcctgccag

SEQ ID NO: 7228 - DNA, 17 bp, Homo sapiens
tgatgtggcctgccagg

SEQ ID NO: 7229 - DNA, 17 bp, Homo sapiens
gatgtggcctgccaggt

SEQ ID NO: 7230 - DNA, 17 bp, Homo sapiens
atgtggcctgccaggtg

SEQ ID NO: 7231 - DNA, 17 bp, Homo sapiens
tgtggcctgccaggtgc

SEQ ID NO: 7232 - DNA, 17 bp, Homo sapiens
gtggcctgccaggtgct

SEQ ID NO: 7233 - DNA, 17 bp, Homo sapiens
tggcctgccaggtgctg

SEQ ID NO: 7234 - DNA, 17 bp, Homo sapiens
ggcctgccaggtgctgg

SEQ ID NO: 7235 - DNA, 17 bp, Homo sapiens
gcctgccaggtgctgga

SEQ ID NO: 7236 - DNA, 17 bp, Homo sapiens
cctgccaggtgctggag

SEQ ID NO: 7237 - DNA, 17 bp, Homo sapiens
ctgccaggtgctggaga

SEQ ID NO: 7238 - DNA, 17 bp, Homo sapiens
tgccaggtgctggagag

SEQ ID NO: 7239 - DNA, 17 bp, Homo sapiens
gccaggtgctggagagt

SEQ ID NO: 7240 - DNA, 17 bp, Homo sapiens
ccaggtgctggagagtg

SEQ ID NO: 7241 - DNA, 17 bp, Homo sapiens
caggtgctggagagtga

SEQ ID NO: 7242 - DNA, 17 bp, Homo sapiens
aggtgctggagagtgag

SEQ ID NO: 7243 - DNA, 17 bp, Homo sapiens
ggtgctggagagtgagc

SEQ ID NO: 7244 - DNA, 17 bp, Homo sapiens
gtgctggagagtgagcg

SEQ ID NO: 7245 - DNA, 17 bp, Homo sapiens
tgctggagagtgagcgg

SEQ ID NO: 7246 - DNA, 17 bp, Homo sapiens
gctggagagtgagcggg

SEQ ID NO: 7247 - DNA, 17 bp, Homo sapiens
ctggagagtgagcgggc

SEQ ID NO: 7248 - DNA, 17 bp, Homo sapiens
tggagagtgagcgggca

SEQ ID NO: 7249 - DNA, 17 bp, Homo sapiens
ggagagtgagcgggcag

SEQ ID NO: 7250 - DNA, 17 bp, Homo sapiens
gagagtgagcgggcaga

SEQ ID NO: 7251 - DNA, 17 bp, Homo sapiens
agagtgagcgggcagag

SEQ ID NO: 7252 - DNA, 17 bp, Homo sapiens
gagtgagcgggcagagc

SEQ ID NO: 7253 - DNA, 17 bp, Homo sapiens
agtgagcgggcagagcg

SEQ ID NO: 7254 - DNA, 17 bp, Homo sapiens
gtgagcgggcagagcgg

SEQ ID NO: 7255 - DNA, 17 bp, Homo sapiens
tgagcgggcagagcggc

SEQ ID NO: 7256 - DNA, 17 bp, Homo sapiens
gagcgggcagagcggct

SEQ ID NO: 7257 - DNA, 17 bp, Homo sapiens
agcgggcagagcggcta

SEQ ID NO: 7258 - DNA, 17 bp, Homo sapiens
gcgggcagagcggctac

SEQ ID NO: 7259 - DNA, 17 bp, Homo sapiens
cgggcagagcggctaca

SEQ ID NO: 7260 - DNA, 17 bp, Homo sapiens
gggcagagcggctacag

SEQ ID NO: 7261 - DNA, 17 bp, Homo sapiens
ggcagagcggctacagg

SEQ ID NO: 7262 - DNA, 17 bp, Homo sapiens
gcagagcggctacaggc

SEQ ID NO: 7263 - DNA, 17 bp, Homo sapiens
cagagcggctacaggcc

SEQ ID NO: 7264 - DNA, 17 bp, Homo sapiens
agagcggctacaggcct

SEQ ID NO: 7265 - DNA, 17 bp, Homo sapiens
gagcggctacaggcctt

SEQ ID NO: 7266 - DNA, 17 bp, Homo sapiens
agcggctacaggccttc

SEQ ID NO: 7267 - DNA, 17 bp, Homo sapiens
gcggctacaggccttcc

SEQ ID NO: 7268 - DNA, 17 bp, Homo sapiens
cggctacaggccttccg

SEQ ID NO: 7269 - DNA, 17 bp, Homo sapiens
ggctacaggccttccgg

SEQ ID NO: 7270 - DNA, 17 bp, Homo sapiens
gctacaggccttccggg

SEQ ID NO: 7271 - DNA, 17 bp, Homo sapiens
ctacaggccttccggga

SEQ ID NO: 7272 - DNA, 17 bp, Homo sapiens
tacaggccttccgggag

SEQ ID NO: 7273 - DNA, 17 bp, Homo sapiens
acaggccttccgggagg

SEQ ID NO: 7274 - DNA, 17 bp, Homo sapiens
caggccttccgggaggt

SEQ ID NO: 7275 - DNA, 17 bp, Homo sapiens
aggccttccgggaggtc

SEQ ID NO: 7276 - DNA, 17 bp, Homo sapiens
ggccttccgggaggtcc

SEQ ID NO: 7277 - DNA, 17 bp, Homo sapiens
gccttccgggaggtcca

SEQ ID NO: 7278 - DNA, 17 bp, Homo sapiens
ccttccgggaggtccag

SEQ ID NO: 7279 - DNA, 17 bp, Homo sapiens
cttccgggaggtccagg

SEQ ID NO: 7280 - DNA, 17 bp, Homo sapiens
ttccgggaggtccagga

SEQ ID NO: 7281 - DNA, 17 bp, Homo sapiens
tccgggaggtccaggag

SEQ ID NO: 7282 - DNA, 17 bp, Homo sapiens
ccgggaggtccaggagc

SEQ ID NO: 7283 - DNA, 17 bp, Homo sapiens
cgggaggtccaggagct

SEQ ID NO: 7284 - DNA, 17 bp, Homo sapiens
gggaggtccaggagctc

SEQ ID NO: 7285 - DNA, 17 bp, Homo sapiens
ggaggtccaggagctca

SEQ ID NO: 7286 - DNA, 17 bp, Homo sapiens
gaggtccaggagctcaa

SEQ ID NO: 7287 - DNA, 17 bp, Homo sapiens
aggtccaggagctcaag

SEQ ID NO: 7288 - DNA, 17 bp, Homo sapiens
ggtccaggagctcaaga

SEQ ID NO: 7289 - DNA, 17 bp, Homo sapiens
gtccaggagctcaagag

SEQ ID NO: 7290 - DNA, 17 bp, Homo sapiens
tccaggagctcaagagc

SEQ ID NO: 7291 - DNA, 17 bp, Homo sapiens
ccaggagctcaagagca

SEQ ID NO: 7292 - DNA, 17 bp, Homo sapiens
caggagctcaagagcaa

SEQ ID NO: 7293 - DNA, 17 bp, Homo sapiens
aggagctcaagagcaag

SEQ ID NO: 7294 - DNA, 17 bp, Homo sapiens
ggagctcaagagcaagc

SEQ ID NO: 7295 - DNA, 17 bp, Homo sapiens
gagctcaagagcaagca

SEQ ID NO: 7296 - DNA, 17 bp, Homo sapiens
agctcaagagcaagcat

SEQ ID NO: 7297 - DNA, 17 bp, Homo sapiens
gctcaagagcaagcatg

SEQ ID NO: 7298 - DNA, 17 bp, Homo sapiens
ctcaagagcaagcatga

SEQ ID NO: 7299 - DNA, 17 bp, Homo sapiens
tcaagagcaagcatgaa

SEQ ID NO: 7300 - DNA, 17 bp, Homo sapiens
caagagcaagcatgaac

SEQ ID NO: 7301 - DNA, 17 bp, Homo sapiens
aagagcaagcatgaaca

SEQ ID NO: 7302 - DNA, 17 bp, Homo sapiens
agagcaagcatgaacaa

SEQ ID NO: 7303 - DNA, 17 bp, Homo sapiens
gagcaagcatgaacaag

SEQ ID NO: 7304 - DNA, 17 bp, Homo sapiens
agcaagcatgaacaagt

SEQ ID NO: 7305 - DNA, 17 bp, Homo sapiens
gcaagcatgaacaagtc

SEQ ID NO: 7306 - DNA, 17 bp, Homo sapiens
caagcatgaacaagtcc

SEQ ID NO: 7307 - DNA, 17 bp, Homo sapiens
aagcatgaacaagtcca

SEQ ID NO: 7308 - DNA, 17 bp, Homo sapiens
agcatgaacaagtccag

SEQ ID NO: 7309 - DNA, 17 bp, Homo sapiens
gcatgaacaagtccaga

SEQ ID NO: 7310 - DNA, 17 bp, Homo sapiens
catgaacaagtccagaa

SEQ ID NO: 7311 - DNA, 17 bp, Homo sapiens
atgaacaagtccagaaa

SEQ ID NO: 7312 - DNA, 17 bp, Homo sapiens
tgaacaagtccagaaaa

SEQ ID NO: 7313 - DNA, 17 bp, Homo sapiens
gaacaagtccagaaaaa

SEQ ID NO: 7314 - DNA, 17 bp, Homo sapiens
aacaagtccagaaaaaa

SEQ ID NO: 7315 - DNA, 17 bp, Homo sapiens
acaagtccagaaaaaac

SEQ ID NO: 7316 - DNA, 17 bp, Homo sapiens
caagtccagaaaaaact

SEQ ID NO: 7317 - DNA, 17 bp, Homo sapiens
aagtccagaaaaaactg

SEQ ID NO: 7318 - DNA, 17 bp, Homo sapiens
agtccagaaaaaactgg

SEQ ID NO: 7319 - DNA, 17 bp, Homo sapiens
gtccagaaaaaactggg

SEQ ID NO: 7320 - DNA, 17 bp, Homo sapiens
tccagaaaaaactggga

SEQ ID NO: 7321 - DNA, 17 bp, Homo sapiens
ccagaaaaaactgggag

SEQ ID NO: 7322 - DNA, 17 bp, Homo sapiens
cagaaaaaactgggaga

SEQ ID NO: 7323 - DNA, 17 bp, Homo sapiens
agaaaaaactgggagat

SEQ ID NO: 7324 - DNA, 17 bp, Homo sapiens
gaaaaaactgggagatg

SEQ ID NO: 7325 - DNA, 17 bp, Homo sapiens
aaaaaactgggagatgt

SEQ ID NO: 7326 - DNA, 17 bp, Homo sapiens
aaaaactgggagatgtg

SEQ ID NO: 7327 - DNA, 17 bp, Homo sapiens
aaaactgggagatgtga

SEQ ID NO: 7328 - DNA, 17 bp, Homo sapiens
aaactgggagatgtgaa

SEQ ID NO: 7329 - DNA, 17 bp, Homo sapiens
aactgggagatgtgaat

SEQ ID NO: 7330 - DNA, 17 bp, Homo sapiens
actgggagatgtgaata

SEQ ID NO: 7331 - DNA, 17 bp, Homo sapiens
ctgggagatgtgaataa

SEQ ID NO: 7332 - DNA, 17 bp, Homo sapiens
tgggagatgtgaataaa

SEQ ID NO: 7333 - DNA, 17 bp, Homo sapiens
gggagatgtgaataaac

SEQ ID NO: 7334 - DNA, 17 bp, Homo sapiens
ggagatgtgaataaaca

SEQ ID NO: 7335 - DNA, 17 bp, Homo sapiens
gagatgtgaataaacag

SEQ ID NO: 7336 - DNA, 17 bp, Homo sapiens
agatgtgaataaacagt

SEQ ID NO: 7337 - DNA, 17 bp, Homo sapiens
gatgtgaataaacagtt

SEQ ID NO: 7338 - DNA, 17 bp, Homo sapiens
atgtgaataaacagttg

SEQ ID NO: 7339 - DNA, 17 bp, Homo sapiens
tgtgaataaacagttgg

SEQ ID NO: 7340 - DNA, 17 bp, Homo sapiens
gtgaataaacagttgga

SEQ ID NO: 7341 - DNA, 17 bp, Homo sapiens
tgaataaacagttggaa

SEQ ID NO: 7342 - DNA, 17 bp, Homo sapiens
gaataaacagttggaag

SEQ ID NO: 7343 - DNA, 17 bp, Homo sapiens
aataaacagttggaaga

SEQ ID NO: 7344 - DNA, 17 bp, Homo sapiens
ataaacagttggaagaa

SEQ ID NO: 7345 - DNA, 17 bp, Homo sapiens
taaacagttggaagaag

SEQ ID NO: 7346 - DNA, 17 bp, Homo sapiens
aaacagttggaagaagc

SEQ ID NO: 7347 - DNA, 17 bp, Homo sapiens
aacagttggaagaagcc

SEQ ID NO: 7348 - DNA, 17 bp, Homo sapiens
acagttggaagaagccc

SEQ ID NO: 7349 - DNA, 17 bp, Homo sapiens
cagttggaagaagccca

SEQ ID NO: 7350 - DNA, 17 bp, Homo sapiens
agttggaagaagcccag

SEQ ID NO: 7351 - DNA, 17 bp, Homo sapiens
gttggaagaagcccagc

SEQ ID NO: 7352 - DNA, 17 bp, Homo sapiens
ttggaagaagcccagca

SEQ ID NO: 7353 - DNA, 17 bp, Homo sapiens
tggaagaagcccagcag

SEQ ID NO: 7354 - DNA, 17 bp, Homo sapiens
ggaagaagcccagcaga

SEQ ID NO: 7355 - DNA, 17 bp, Homo sapiens
gaagaagcccagcagaa

SEQ ID NO: 7356 - DNA, 17 bp, Homo sapiens
aagaagcccagcagaaa

SEQ ID NO: 7357 - DNA, 17 bp, Homo sapiens
agaagcccagcagaaaa

SEQ ID NO: 7358 - DNA, 17 bp, Homo sapiens
gaagcccagcagaaaat

SEQ ID NO: 7359 - DNA, 17 bp, Homo sapiens
aagcccagcagaaaatt

SEQ ID NO: 7360 - DNA, 17 bp, Homo sapiens
agcccagcagaaaattc

SEQ ID NO: 7361 - DNA, 17 bp, Homo sapiens
gcccagcagaaaattca

SEQ ID NO: 7362 - DNA, 17 bp, Homo sapiens
cccagcagaaaattcag

SEQ ID NO: 7363 - DNA, 17 bp, Homo sapiens
ccagcagaaaattcagt

SEQ ID NO: 7364 - DNA, 17 bp, Homo sapiens
cagcagaaaattcagtt

SEQ ID NO: 7365 - DNA, 17 bp, Homo sapiens
agcagaaaattcagttg

SEQ ID NO: 7366 - DNA, 17 bp, Homo sapiens
gcagaaaattcagttga

SEQ ID NO: 7367 - DNA, 17 bp, Homo sapiens
cagaaaattcagttgaa

SEQ ID NO: 7368 - DNA, 17 bp, Homo sapiens
agaaaattcagttgaat

SEQ ID NO: 7369 - DNA, 17 bp, Homo sapiens
gaaaattcagttgaatg

SEQ ID NO: 7370 - DNA, 17 bp, Homo sapiens
aaaattcagttgaatga

SEQ ID NO: 7371 - DNA, 17 bp, Homo sapiens
aaattcagttgaatgac

SEQ ID NO: 7372 - DNA, 17 bp, Homo sapiens
aattcagttgaatgact

SEQ ID NO: 7373 - DNA, 17 bp, Homo sapiens
attcagttgaatgactt

SEQ ID NO: 7374 - DNA, 17 bp, Homo sapiens
ttcagttgaatgacttg

SEQ ID NO: 7375 - DNA, 17 bp, Homo sapiens
tcagttgaatgacttgg

SEQ ID NO: 7376 - DNA, 17 bp, Homo sapiens
cagttgaatgacttgga

SEQ ID NO: 7377 - DNA, 17 bp, Homo sapiens
agttgaatgacttggaa

SEQ ID NO: 7378 - DNA, 17 bp, Homo sapiens
gttgaatgacttggaaa

SEQ ID NO: 7379 - DNA, 17 bp, Homo sapiens
ttgaatgacttggaaag

SEQ ID NO: 7380 - DNA, 17 bp, Homo sapiens
tgaatgacttggaaagg

SEQ ID NO: 7381 - DNA, 17 bp, Homo sapiens
gaatgacttggaaaggg

SEQ ID NO: 7382 - DNA, 17 bp, Homo sapiens
aatgacttggaaaggga

SEQ ID NO: 7383 - DNA, 17 bp, Homo sapiens
atgacttggaaagggat

SEQ ID NO: 7384 - DNA, 17 bp, Homo sapiens
tgacttggaaagggatc

SEQ ID NO: 7385 - DNA, 17 bp, Homo sapiens
gacttggaaagggatcc

SEQ ID NO: 7386 - DNA, 17 bp, Homo sapiens
acttggaaagggatccc

SEQ ID NO: 7387 - DNA, 17 bp, Homo sapiens
cttggaaagggatccca

SEQ ID NO: 7388 - DNA, 17 bp, Homo sapiens
ttggaaagggatcccac

SEQ ID NO: 7389 - DNA, 17 bp, Homo sapiens
tggaaagggatcccact

SEQ ID NO: 7390 - DNA, 17 bp, Homo sapiens
ggaaagggatcccactg

SEQ ID NO: 7391 - DNA, 17 bp, Homo sapiens
gaaagggatcccactgg

SEQ ID NO: 7392 - DNA, 17 bp, Homo sapiens
aaagggatcccactgga

SEQ ID NO: 7393 - DNA, 17 bp, Homo sapiens
aagggatcccactggag

SEQ ID NO: 7394 - DNA, 17 bp, Homo sapiens
agggatcccactggagg

SEQ ID NO: 7395 - DNA, 17 bp, Homo sapiens
gggatcccactggagga

SEQ ID NO: 7396 - DNA, 17 bp, Homo sapiens
ggatcccactggaggag

SEQ ID NO: 7397 - DNA, 17 bp, Homo sapiens
gatcccactggaggagc

SEQ ID NO: 7398 - DNA, 17 bp, Homo sapiens
atcccactggaggagca

SEQ ID NO: 7399 - DNA, 17 bp, Homo sapiens
tcccactggaggagcag

SEQ ID NO: 7400 - DNA, 17 bp, Homo sapiens
cccactggaggagcaga

SEQ ID NO: 7401 - DNA, 17 bp, Homo sapiens
ccactggaggagcagac

SEQ ID NO: 7402 - DNA, 17 bp, Homo sapiens
cactggaggagcagacg

SEQ ID NO: 7403 - DNA, 17 bp, Homo sapiens
actggaggagcagacga

SEQ ID NO: 7404 - DNA, 17 bp, Homo sapiens
ctggaggagcagacgag

SEQ ID NO: 7405 - DNA, 17 bp, Homo sapiens
tggaggagcagacgagt

SEQ ID NO: 7406 - DNA, 17 bp, Homo sapiens
ggaggagcagacgagtg

SEQ ID NO: 7407 - DNA, 17 bp, Homo sapiens
gaggagcagacgagtgg

SEQ ID NO: 7408 - DNA, 17 bp, Homo sapiens
aggagcagacgagtggc

SEQ ID NO: 7409 - DNA, 17 bp, Homo sapiens
ggagcagacgagtggca

SEQ ID NO: 7410 - DNA, 17 bp, Homo sapiens
gagcagacgagtggcag

SEQ ID NO: 7411 - DNA, 17 bp, Homo sapiens
agcagacgagtggcaga

SEQ ID NO: 7412 - DNA, 17 bp, Homo sapiens
gcagacgagtggcagat

SEQ ID NO: 7413 - DNA, 17 bp, Homo sapiens
cagacgagtggcagatg

SEQ ID NO: 7414 - DNA, 17 bp, Homo sapiens
agacgagtggcagatgc

SEQ ID NO: 7415 - DNA, 17 bp, Homo sapiens
gacgagtggcagatgcg

SEQ ID NO: 7416 - DNA, 17 bp, Homo sapiens
acgagtggcagatgcgc

SEQ ID NO: 7417 - DNA, 17 bp, Homo sapiens
cgagtggcagatgcgct

SEQ ID NO: 7418 - DNA, 17 bp, Homo sapiens
gagtggcagatgcgctt

SEQ ID NO: 7419 - DNA, 17 bp, Homo sapiens
agtggcagatgcgcttc

SEQ ID NO: 7420 - DNA, 17 bp, Homo sapiens
gtggcagatgcgcttcg

SEQ ID NO: 7421 - DNA, 17 bp, Homo sapiens
tggcagatgcgcttcga

SEQ ID NO: 7422 - DNA, 17 bp, Homo sapiens
ggcagatgcgcttcgac

SEQ ID NO: 7423 - DNA, 17 bp, Homo sapiens
gcagatgcgcttcgact

SEQ ID NO: 7424 - DNA, 17 bp, Homo sapiens
cagatgcgcttcgactg

SEQ ID NO: 7425 - DNA, 17 bp, Homo sapiens
agatgcgcttcgactgt

SEQ ID NO: 7426 - DNA, 17 bp, Homo sapiens
gatgcgcttcgactgtg

SEQ ID NO: 7427 - DNA, 17 bp, Homo sapiens
atgcgcttcgactgtgc

SEQ ID NO: 7428 - DNA, 17 bp, Homo sapiens
tgcgcttcgactgtgct

SEQ ID NO: 7429 - DNA, 17 bp, Homo sapiens
gcgcttcgactgtgctc

SEQ ID NO: 7430 - DNA, 17 bp, Homo sapiens
cgcttcgactgtgctca

SEQ ID NO: 7431 - DNA, 17 bp, Homo sapiens
gcttcgactgtgctcag

SEQ ID NO: 7432 - DNA, 17 bp, Homo sapiens
cttcgactgtgctcaga

SEQ ID NO: 7433 - DNA, 17 bp, Homo sapiens
ttcgactgtgctcagat

SEQ ID NO: 7434 - DNA, 17 bp, Homo sapiens
tcgactgtgctcagatg

SEQ ID NO: 7435 - DNA, 17 bp, Homo sapiens
cgactgtgctcagatgg

SEQ ID NO: 7436 - DNA, 17 bp, Homo sapiens
gactgtgctcagatgga

SEQ ID NO: 7437 - DNA, 17 bp, Homo sapiens
actgtgctcagatggag

SEQ ID NO: 7438 - DNA, 17 bp, Homo sapiens
ctgtgctcagatggaga

SEQ ID NO: 7439 - DNA, 17 bp, Homo sapiens
tgtgctcagatggagaa

SEQ ID NO: 7440 - DNA, 17 bp, Homo sapiens
gtgctcagatggagaac

SEQ ID NO: 7441 - DNA, 17 bp, Homo sapiens
tgctcagatggagaacg

SEQ ID NO: 7442 - DNA, 17 bp, Homo sapiens
gctcagatggagaacga

SEQ ID NO: 7443 - DNA, 17 bp, Homo sapiens
ctcagatggagaacgag

SEQ ID NO: 7444 - DNA, 17 bp, Homo sapiens
tcagatggagaacgagt

SEQ ID NO: 7445 - DNA, 17 bp, Homo sapiens
cagatggagaacgagtt

SEQ ID NO: 7446 - DNA, 17 bp, Homo sapiens
agatggagaacgagttc

SEQ ID NO: 7447 - DNA, 17 bp, Homo sapiens
gatggagaacgagttcc

SEQ ID NO: 7448 - DNA, 17 bp, Homo sapiens
atggagaacgagttcct

SEQ ID NO: 7449 - DNA, 17 bp, Homo sapiens
tggagaacgagttcctc

SEQ ID NO: 7450 - DNA, 17 bp, Homo sapiens
ggagaacgagttcctca

SEQ ID NO: 7451 - DNA, 17 bp, Homo sapiens
gagaacgagttcctcag

SEQ ID NO: 7452 - DNA, 17 bp, Homo sapiens
agaacgagttcctcaga

SEQ ID NO: 7453 - DNA, 17 bp, Homo sapiens
gaacgagttcctcagaa

SEQ ID NO: 7454 - DNA, 17 bp, Homo sapiens
aacgagttcctcagaaa

SEQ ID NO: 7455 - DNA, 17 bp, Homo sapiens
acgagttcctcagaaag

SEQ ID NO: 7456 - DNA, 17 bp, Homo sapiens
cgagttcctcagaaagc

SEQ ID NO: 7457 - DNA, 17 bp, Homo sapiens
gagttcctcagaaagcg

SEQ ID NO: 7458 - DNA, 17 bp, Homo sapiens
agttcctcagaaagcgt

SEQ ID NO: 7459 - DNA, 17 bp, Homo sapiens
gttcctcagaaagcgtc

SEQ ID NO: 7460 - DNA, 17 bp, Homo sapiens
ttcctcagaaagcgtct

SEQ ID NO: 7461 - DNA, 17 bp, Homo sapiens
tcctcagaaagcgtctg

SEQ ID NO: 7462 - DNA, 17 bp, Homo sapiens
cctcagaaagcgtctgc

SEQ ID NO: 7463 - DNA, 17 bp, Homo sapiens
ctcagaaagcgtctgca

SEQ ID NO: 7464 - DNA, 17 bp, Homo sapiens
tcagaaagcgtctgcag

SEQ ID NO: 7465 - DNA, 17 bp, Homo sapiens
cagaaagcgtctgcagc

SEQ ID NO: 7466 - DNA, 17 bp, Homo sapiens
agaaagcgtctgcagca

SEQ ID NO: 7467 - DNA, 17 bp, Homo sapiens
gaaagcgtctgcagcaa

SEQ ID NO: 7468 - DNA, 17 bp, Homo sapiens
aaagcgtctgcagcaat

SEQ ID NO: 7469 - DNA, 17 bp, Homo sapiens
aagcgtctgcagcaatg

SEQ ID NO: 7470 - DNA, 17 bp, Homo sapiens
agcgtctgcagcaatgc

SEQ ID NO: 7471 - DNA, 17 bp, Homo sapiens
gcgtctgcagcaatgcg

SEQ ID NO: 7472 - DNA, 17 bp, Homo sapiens
cgtctgcagcaatgcga

SEQ ID NO: 7473 - DNA, 17 bp, Homo sapiens
gtctgcagcaatgcgag

SEQ ID NO: 7474 - DNA, 17 bp, Homo sapiens
tctgcagcaatgcgagg

SEQ ID NO: 7475 - DNA, 17 bp, Homo sapiens
ctgcagcaatgcgagga

SEQ ID NO: 7476 - DNA, 17 bp, Homo sapiens
tgcagcaatgcgaggag

SEQ ID NO: 7477 - DNA, 17 bp, Homo sapiens
gcagcaatgcgaggaga

SEQ ID NO: 7478 - DNA, 17 bp, Homo sapiens
cagcaatgcgaggagag

SEQ ID NO: 7479 - DNA, 17 bp, Homo sapiens
agcaatgcgaggagagg

SEQ ID NO: 7480 - DNA, 17 bp, Homo sapiens
gcaatgcgaggagaggc

SEQ ID NO: 7481 - DNA, 17 bp, Homo sapiens
caatgcgaggagaggct

SEQ ID NO: 7482 - DNA, 17 bp, Homo sapiens
aatgcgaggagaggctg

SEQ ID NO: 7483 - DNA, 17 bp, Homo sapiens
atgcgaggagaggctgg

SEQ ID NO: 7484 - DNA, 17 bp, Homo sapiens
tgcgaggagaggctgga

SEQ ID NO: 7485 - DNA, 17 bp, Homo sapiens
gcgaggagaggctggac

SEQ ID NO: 7486 - DNA, 17 bp, Homo sapiens
cgaggagaggctggact

SEQ ID NO: 7487 - DNA, 17 bp, Homo sapiens
gaggagaggctggactc

SEQ ID NO: 7488 - DNA, 17 bp, Homo sapiens
aggagaggctggactcg

SEQ ID NO: 7489 - DNA, 17 bp, Homo sapiens
ggagaggctggactcgg

SEQ ID NO: 7490 - DNA, 17 bp, Homo sapiens
gagaggctggactcgga

SEQ ID NO: 7491 - DNA, 17 bp, Homo sapiens
agaggctggactcggag

SEQ ID NO: 7492 - DNA, 17 bp, Homo sapiens
gaggctggactcggagc

SEQ ID NO: 7493 - DNA, 17 bp, Homo sapiens
aggctggactcggagct

SEQ ID NO: 7494 - DNA, 17 bp, Homo sapiens
ggctggactcggagctg

SEQ ID NO: 7495 - DNA, 17 bp, Homo sapiens
gctggactcggagctga

SEQ ID NO: 7496 - DNA, 17 bp, Homo sapiens
ctggactcggagctgac

SEQ ID NO: 7497 - DNA, 17 bp, Homo sapiens
tggactcggagctgaca

SEQ ID NO: 7498 - DNA, 17 bp, Homo sapiens
ggactcggagctgacag

SEQ ID NO: 7499 - DNA, 17 bp, Homo sapiens
gactcggagctgacagc

SEQ ID NO: 7500 - DNA, 17 bp, Homo sapiens
actcggagctgacagcc

SEQ ID NO: 7501 - DNA, 17 bp, Homo sapiens
ctcggagctgacagcca

SEQ ID NO: 7502 - DNA, 17 bp, Homo sapiens
tcggagctgacagccag

SEQ ID NO: 7503 - DNA, 17 bp, Homo sapiens
cggagctgacagccagg

SEQ ID NO: 7504 - DNA, 17 bp, Homo sapiens
ggagctgacagccagga

SEQ ID NO: 7505 - DNA, 17 bp, Homo sapiens
gagctgacagccaggaa

SEQ ID NO: 7506 - DNA, 17 bp, Homo sapiens
agctgacagccaggaaa

SEQ ID NO: 7507 - DNA, 17 bp, Homo sapiens
gctgacagccaggaaag

SEQ ID NO: 7508 - DNA, 17 bp, Homo sapiens
ctgacagccaggaaaga

SEQ ID NO: 7509 - DNA, 17 bp, Homo sapiens
tgacagccaggaaagag

SEQ ID NO: 7510 - DNA, 17 bp, Homo sapiens
gacagccaggaaagagc

SEQ ID NO: 7511 - DNA, 17 bp, Homo sapiens
acagccaggaaagagct

SEQ ID NO: 7512 - DNA, 17 bp, Homo sapiens
cagccaggaaagagctg

SEQ ID NO: 7513 - DNA, 17 bp, Homo sapiens
agccaggaaagagctgg

SEQ ID NO: 7514 - DNA, 17 bp, Homo sapiens
gccaggaaagagctgga

SEQ ID NO: 7515 - DNA, 17 bp, Homo sapiens
ccaggaaagagctggag

SEQ ID NO: 7516 - DNA, 17 bp, Homo sapiens
caggaaagagctggagc

SEQ ID NO: 7517 - DNA, 17 bp, Homo sapiens
aggaaagagctggagca

SEQ ID NO: 7518 - DNA, 17 bp, Homo sapiens
ggaaagagctggagcaa

SEQ ID NO: 7519 - DNA, 17 bp, Homo sapiens
gaaagagctggagcaaa

SEQ ID NO: 7520 - DNA, 17 bp, Homo sapiens
aaagagctggagcaaaa

SEQ ID NO: 7521 - DNA, 17 bp, Homo sapiens
aagagctggagcaaaag

SEQ ID NO: 7522 - DNA, 17 bp, Homo sapiens
agagctggagcaaaagc

SEQ ID NO: 7523 - DNA, 17 bp, Homo sapiens
gagctggagcaaaagct

SEQ ID NO: 7524 - DNA, 17 bp, Homo sapiens
agctggagcaaaagctt

SEQ ID NO: 7525 - DNA, 17 bp, Homo sapiens
gctggagcaaaagcttg

SEQ ID NO: 7526 - DNA, 17 bp, Homo sapiens
ctggagcaaaagcttgg

SEQ ID NO: 7527 - DNA, 17 bp, Homo sapiens
tggagcaaaagcttggg

SEQ ID NO: 7528 - DNA, 17 bp, Homo sapiens
ggagcaaaagcttgggg

SEQ ID NO: 7529 - DNA, 17 bp, Homo sapiens
gagcaaaagcttgggga

SEQ ID NO: 7530 - DNA, 17 bp, Homo sapiens
agcaaaagcttggggag

SEQ ID NO: 7531 - DNA, 17 bp, Homo sapiens
gcaaaagcttggggagt

SEQ ID NO: 7532 - DNA, 17 bp, Homo sapiens
caaaagcttggggagtt

SEQ ID NO: 7533 - DNA, 17 bp, Homo sapiens
aaaagcttggggagttg

SEQ ID NO: 7534 - DNA, 17 bp, Homo sapiens
aaagcttggggagttgc

SEQ ID NO: 7535 - DNA, 17 bp, Homo sapiens
aagcttggggagttgca

SEQ ID NO: 7536 - DNA, 17 bp, Homo sapiens
agcttggggagttgcaa

SEQ ID NO: 7537 - DNA, 17 bp, Homo sapiens
gcttggggagttgcaaa

SEQ ID NO: 7538 - DNA, 17 bp, Homo sapiens
cttggggagttgcaaag

SEQ ID NO: 7539 - DNA, 17 bp, Homo sapiens
ttggggagttgcaaagt

SEQ ID NO: 7540 - DNA, 17 bp, Homo sapiens
tggggagttgcaaagtg

SEQ ID NO: 7541 - DNA, 17 bp, Homo sapiens
ggggagttgcaaagtgc

SEQ ID NO: 7542 - DNA, 17 bp, Homo sapiens
gggagttgcaaagtgct

SEQ ID NO: 7543 - DNA, 17 bp, Homo sapiens
ggagttgcaaagtgctt

SEQ ID NO: 7544 - DNA, 17 bp, Homo sapiens
gagttgcaaagtgctta

SEQ ID NO: 7545 - DNA, 17 bp, Homo sapiens
agttgcaaagtgcttat

SEQ ID NO: 7546 - DNA, 17 bp, Homo sapiens
gttgcaaagtgcttatg

SEQ ID NO: 7547 - DNA, 17 bp, Homo sapiens
ttgcaaagtgcttatga

SEQ ID NO: 7548 - DNA, 17 bp, Homo sapiens
tgcaaagtgcttatgac

SEQ ID NO: 7549 - DNA, 17 bp, Homo sapiens
gcaaagtgcttatgacg

SEQ ID NO: 7550 - DNA, 17 bp, Homo sapiens
caaagtgcttatgacgg

SEQ ID NO: 7551 - DNA, 17 bp, Homo sapiens
aaagtgcttatgacggg

SEQ ID NO: 7552 - DNA, 17 bp, Homo sapiens
aagtgcttatgacgggg

SEQ ID NO: 7553 - DNA, 17 bp, Homo sapiens
agtgcttatgacggggc

SEQ ID NO: 7554 - DNA, 17 bp, Homo sapiens
gtgcttatgacggggcc

SEQ ID NO: 7555 - DNA, 17 bp, Homo sapiens
tgcttatgacggggcca

SEQ ID NO: 7556 - DNA, 17 bp, Homo sapiens
gcttatgacggggccaa

SEQ ID NO: 7557 - DNA, 17 bp, Homo sapiens
cttatgacggggccaag

SEQ ID NO: 7558 - DNA, 17 bp, Homo sapiens
ttatgacggggccaaga

SEQ ID NO: 7559 - DNA, 17 bp, Homo sapiens
tatgacggggccaagaa

SEQ ID NO: 7560 - DNA, 17 bp, Homo sapiens
atgacggggccaagaag

SEQ ID NO: 7561 - DNA, 17 bp, Homo sapiens
tgacggggccaagaaga

SEQ ID NO: 7562 - DNA, 17 bp, Homo sapiens
gacggggccaagaagat

SEQ ID NO: 7563 - DNA, 17 bp, Homo sapiens
acggggccaagaagatg

SEQ ID NO: 7564 - DNA, 17 bp, Homo sapiens
cggggccaagaagatgg

SEQ ID NO: 7565 - DNA, 17 bp, Homo sapiens
ggggccaagaagatggc

SEQ ID NO: 7566 - DNA, 17 bp, Homo sapiens
gggccaagaagatggct

SEQ ID NO: 7567 - DNA, 17 bp, Homo sapiens
ggccaagaagatggctc

SEQ ID NO: 7568 - DNA, 17 bp, Homo sapiens
gccaagaagatggctca

SEQ ID NO: 7569 - DNA, 17 bp, Homo sapiens
ccaagaagatggctcac

SEQ ID NO: 7570 - DNA, 17 bp, Homo sapiens
caagaagatggctcacc

SEQ ID NO: 7571 - DNA, 17 bp, Homo sapiens
aagaagatggctcacca

SEQ ID NO: 7572 - DNA, 17 bp, Homo sapiens
agaagatggctcaccaa

SEQ ID NO: 7573 - DNA, 17 bp, Homo sapiens
gaagatggctcaccaac

SEQ ID NO: 7574 - DNA, 17 bp, Homo sapiens
aagatggctcaccaact

SEQ ID NO: 7575 - DNA, 17 bp, Homo sapiens
agatggctcaccaactg

SEQ ID NO: 7576 - DNA, 17 bp, Homo sapiens
gatggctcaccaactga

SEQ ID NO: 7577 - DNA, 17 bp, Homo sapiens
atggctcaccaactgaa

SEQ ID NO: 7578 - DNA, 17 bp, Homo sapiens
tggctcaccaactgaag

SEQ ID NO: 7579 - DNA, 17 bp, Homo sapiens
ggctcaccaactgaaga

SEQ ID NO: 7580 - DNA, 17 bp, Homo sapiens
gctcaccaactgaagag

SEQ ID NO: 7581 - DNA, 17 bp, Homo sapiens
ctcaccaactgaagagg

SEQ ID NO: 7582 - DNA, 17 bp, Homo sapiens
tcaccaactgaagagga

SEQ ID NO: 7583 - DNA, 17 bp, Homo sapiens
caccaactgaagaggaa

SEQ ID NO: 7584 - DNA, 17 bp, Homo sapiens
accaactgaagaggaag

SEQ ID NO: 7585 - DNA, 17 bp, Homo sapiens
ccaactgaagaggaagt

SEQ ID NO: 7586 - DNA, 17 bp, Homo sapiens
caactgaagaggaagtg

SEQ ID NO: 7587 - DNA, 17 bp, Homo sapiens
aactgaagaggaagtgc

SEQ ID NO: 7588 - DNA, 17 bp, Homo sapiens
actgaagaggaagtgcc

SEQ ID NO: 7589 - DNA, 17 bp, Homo sapiens
ctgaagaggaagtgcca

SEQ ID NO: 7590 - DNA, 17 bp, Homo sapiens
tgaagaggaagtgccac

SEQ ID NO: 7591 - DNA, 17 bp, Homo sapiens
gaagaggaagtgccacc

SEQ ID NO: 7592 - DNA, 17 bp, Homo sapiens
aagaggaagtgccacca

SEQ ID NO: 7593 - DNA, 17 bp, Homo sapiens
agaggaagtgccaccat

SEQ ID NO: 7594 - DNA, 17 bp, Homo sapiens
gaggaagtgccaccatc

SEQ ID NO: 7595 - DNA, 17 bp, Homo sapiens
aggaagtgccaccatct

SEQ ID NO: 7596 - DNA, 17 bp, Homo sapiens
ggaagtgccaccatctt

SEQ ID NO: 7597 - DNA, 17 bp, Homo sapiens
gaagtgccaccatctta

SEQ ID NO: 7598 - DNA, 17 bp, Homo sapiens
aagtgccaccatcttac

SEQ ID NO: 7599 - DNA, 17 bp, Homo sapiens
agtgccaccatcttacc

SEQ ID NO: 7600 - DNA, 17 bp, Homo sapiens
gtgccaccatcttacct

SEQ ID NO: 7601 - DNA, 17 bp, Homo sapiens
tgccaccatcttacctg

SEQ ID NO: 7602 - DNA, 17 bp, Homo sapiens
gccaccatcttacctgt

SEQ ID NO: 7603 - DNA, 17 bp, Homo sapiens
ccaccatcttacctgtg

SEQ ID NO: 7604 - DNA, 17 bp, Homo sapiens
caccatcttacctgtga

SEQ ID NO: 7605 - DNA, 17 bp, Homo sapiens
accatcttacctgtgac

SEQ ID NO: 7606 - DNA, 17 bp, Homo sapiens
ccatcttacctgtgacc

SEQ ID NO: 7607 - DNA, 17 bp, Homo sapiens
catcttacctgtgacct

SEQ ID NO: 7608 - DNA, 17 bp, Homo sapiens
atcttacctgtgacctt

SEQ ID NO: 7609 - DNA, 17 bp, Homo sapiens
tcttacctgtgaccttg

SEQ ID NO: 7610 - DNA, 17 bp, Homo sapiens
cttacctgtgaccttga

SEQ ID NO: 7611 - DNA, 17 bp, Homo sapiens
ttacctgtgaccttgag

SEQ ID NO: 7612 - DNA, 17 bp, Homo sapiens
tacctgtgaccttgagg

SEQ ID NO: 7613 - DNA, 17 bp, Homo sapiens
acctgtgaccttgagga

SEQ ID NO: 7614 - DNA, 17 bp, Homo sapiens
cctgtgaccttgaggat

SEQ ID NO: 7615 - DNA, 17 bp, Homo sapiens
ctgtgaccttgaggata

SEQ ID NO: 7616 - DNA, 17 bp, Homo sapiens
tgtgaccttgaggatac

SEQ ID NO: 7617 - DNA, 17 bp, Homo sapiens
gtgaccttgaggatacc

SEQ ID NO: 7618 - DNA, 17 bp, Homo sapiens
tgaccttgaggatacct

SEQ ID NO: 7619 - DNA, 17 bp, Homo sapiens
gaccttgaggatacctg

SEQ ID NO: 7620 - DNA, 17 bp, Homo sapiens
accttgaggatacctgc

SEQ ID NO: 7621 - DNA, 17 bp, Homo sapiens
ccttgaggatacctgcg

SEQ ID NO: 7622 - DNA, 17 bp, Homo sapiens
cttgaggatacctgcgt

SEQ ID NO: 7623 - DNA, 17 bp, Homo sapiens
ttgaggatacctgcgtc

SEQ ID NO: 7624 - DNA, 17 bp, Homo sapiens
tgaggatacctgcgtcc

SEQ ID NO: 7625 - DNA, 17 bp, Homo sapiens
gaggatacctgcgtcct

SEQ ID NO: 7626 - DNA, 17 bp, Homo sapiens
aggatacctgcgtcctg

SEQ ID NO: 7627 - DNA, 17 bp, Homo sapiens
ggatacctgcgtcctgc

SEQ ID NO: 7628 - DNA, 17 bp, Homo sapiens
gatacctgcgtcctgct

SEQ ID NO: 7629 - DNA, 17 bp, Homo sapiens
atacctgcgtcctgcta

SEQ ID NO: 7630 - DNA, 17 bp, Homo sapiens
tacctgcgtcctgctag

SEQ ID NO: 7631 - DNA, 17 bp, Homo sapiens
acctgcgtcctgctaga

SEQ ID NO: 7632 - DNA, 17 bp, Homo sapiens
cctgcgtcctgctagag

SEQ ID NO: 7633 - DNA, 17 bp, Homo sapiens
ctgcgtcctgctagaga

SEQ ID NO: 7634 - DNA, 17 bp, Homo sapiens
tgcgtcctgctagagaa

SEQ ID NO: 7635 - DNA, 17 bp, Homo sapiens
gcgtcctgctagagaac

SEQ ID NO: 7636 - DNA, 17 bp, Homo sapiens
cgtcctgctagagaacc

SEQ ID NO: 7637 - DNA, 17 bp, Homo sapiens
gtcctgctagagaacca

SEQ ID NO: 7638 - DNA, 17 bp, Homo sapiens
tcctgctagagaaccaa

SEQ ID NO: 7639 - DNA, 17 bp, Homo sapiens
cctgctagagaaccaac

SEQ ID NO: 7640 - DNA, 17 bp, Homo sapiens
ctgctagagaaccaaca

SEQ ID NO: 7641 - DNA, 17 bp, Homo sapiens
tgctagagaaccaacaa

SEQ ID NO: 7642 - DNA, 17 bp, Homo sapiens
gctagagaaccaacaaa

SEQ ID NO: 7643 - DNA, 17 bp, Homo sapiens
ctagagaaccaacaaag

SEQ ID NO: 7644 - DNA, 17 bp, Homo sapiens
tagagaaccaacaaagt

SEQ ID NO: 7645 - DNA, 17 bp, Homo sapiens
agagaaccaacaaagtc

SEQ ID NO: 7646 - DNA, 17 bp, Homo sapiens
gagaaccaacaaagtcg

SEQ ID NO: 7647 - DNA, 17 bp, Homo sapiens
agaaccaacaaagtcga

SEQ ID NO: 7648 - DNA, 17 bp, Homo sapiens
gaaccaacaaagtcgaa

SEQ ID NO: 7649 - DNA, 17 bp, Homo sapiens
aaccaacaaagtcgaaa

SEQ ID NO: 7650 - DNA, 17 bp, Homo sapiens
accaacaaagtcgaaac

SEQ ID NO: 7651 - DNA, 17 bp, Homo sapiens
ccaacaaagtcgaaacc

SEQ ID NO: 7652 - DNA, 17 bp, Homo sapiens
caacaaagtcgaaacca

SEQ ID NO: 7653 - DNA, 17 bp, Homo sapiens
aacaaagtcgaaaccat

SEQ ID NO: 7654 - DNA, 17 bp, Homo sapiens
acaaagtcgaaaccatg

SEQ ID NO: 7655 - DNA, 17 bp, Homo sapiens
caaagtcgaaaccatga

SEQ ID NO: 7656 - DNA, 17 bp, Homo sapiens
aaagtcgaaaccatgag

SEQ ID NO: 7657 - DNA, 17 bp, Homo sapiens
aagtcgaaaccatgagc

SEQ ID NO: 7658 - DNA, 17 bp, Homo sapiens
agtcgaaaccatgagct

SEQ ID NO: 7659 - DNA, 17 bp, Homo sapiens
gtcgaaaccatgagctg

SEQ ID NO: 7660 - DNA, 17 bp, Homo sapiens
tcgaaaccatgagctgg

SEQ ID NO: 7661 - DNA, 17 bp, Homo sapiens
cgaaaccatgagctgga

SEQ ID NO: 7662 - DNA, 17 bp, Homo sapiens
gaaaccatgagctggag

SEQ ID NO: 7663 - DNA, 17 bp, Homo sapiens
aaaccatgagctggaga

SEQ ID NO: 7664 - DNA, 17 bp, Homo sapiens
aaccatgagctggagaa

SEQ ID NO: 7665 - DNA, 17 bp, Homo sapiens
accatgagctggagaag

SEQ ID NO: 7666 - DNA, 17 bp, Homo sapiens
ccatgagctggagaaga

SEQ ID NO: 7667 - DNA, 17 bp, Homo sapiens
catgagctggagaagaa

SEQ ID NO: 7668 - DNA, 17 bp, Homo sapiens
atgagctggagaagaag

SEQ ID NO: 7669 - DNA, 17 bp, Homo sapiens
tgagctggagaagaagc

SEQ ID NO: 7670 - DNA, 17 bp, Homo sapiens
gagctggagaagaagca

SEQ ID NO: 7671 - DNA, 17 bp, Homo sapiens
agctggagaagaagcag

SEQ ID NO: 7672 - DNA, 17 bp, Homo sapiens
gctggagaagaagcaga

SEQ ID NO: 7673 - DNA, 17 bp, Homo sapiens
ctggagaagaagcagaa

SEQ ID NO: 7674 - DNA, 17 bp, Homo sapiens
tggagaagaagcagaag

SEQ ID NO: 7675 - DNA, 17 bp, Homo sapiens
ggagaagaagcagaaga

SEQ ID NO: 7676 - DNA, 17 bp, Homo sapiens
gagaagaagcagaagaa

SEQ ID NO: 7677 - DNA, 17 bp, Homo sapiens
agaagaagcagaagaag

SEQ ID NO: 7678 - DNA, 17 bp, Homo sapiens
gaagaagcagaagaagt

SEQ ID NO: 7679 - DNA, 17 bp, Homo sapiens
aagaagcagaagaagtt

SEQ ID NO: 7680 - DNA, 17 bp, Homo sapiens
agaagcagaagaagttt

SEQ ID NO: 7681 - DNA, 17 bp, Homo sapiens
gaagcagaagaagtttg

SEQ ID NO: 7682 - DNA, 17 bp, Homo sapiens
aagcagaagaagtttga

SEQ ID NO: 7683 - DNA, 17 bp, Homo sapiens
agcagaagaagtttgac

SEQ ID NO: 7684 - DNA, 17 bp, Homo sapiens
gcagaagaagtttgacc

SEQ ID NO: 7685 - DNA, 17 bp, Homo sapiens
cagaagaagtttgacct

SEQ ID NO: 7686 - DNA, 17 bp, Homo sapiens
agaagaagtttgacctg

SEQ ID NO: 7687 - DNA, 17 bp, Homo sapiens
gaagaagtttgacctgc

SEQ ID NO: 7688 - DNA, 17 bp, Homo sapiens
aagaagtttgacctgca

SEQ ID NO: 7689 - DNA, 17 bp, Homo sapiens
agaagtttgacctgcag

SEQ ID NO: 7690 - DNA, 17 bp, Homo sapiens
gaagtttgacctgcagc

SEQ ID NO: 7691 - DNA, 17 bp, Homo sapiens
aagtttgacctgcagct

SEQ ID NO: 7692 - DNA, 17 bp, Homo sapiens
agtttgacctgcagctg

SEQ ID NO: 7693 - DNA, 17 bp, Homo sapiens
gtttgacctgcagctgg

SEQ ID NO: 7694 - DNA, 17 bp, Homo sapiens
tttgacctgcagctggc

SEQ ID NO: 7695 - DNA, 17 bp, Homo sapiens
ttgacctgcagctggcc

SEQ ID NO: 7696 - DNA, 17 bp, Homo sapiens
tgacctgcagctggccc

SEQ ID NO: 7697 - DNA, 17 bp, Homo sapiens
gacctgcagctggccca

SEQ ID NO: 7698 - DNA, 17 bp, Homo sapiens
acctgcagctggcccag

SEQ ID NO: 7699 - DNA, 17 bp, Homo sapiens
cctgcagctggcccagg

SEQ ID NO: 7700 - DNA, 17 bp, Homo sapiens
ctgcagctggcccaggc

SEQ ID NO: 7701 - DNA, 17 bp, Homo sapiens
tgcagctggcccaggcc

SEQ ID NO: 7702 - DNA, 17 bp, Homo sapiens
gcagctggcccaggccc

SEQ ID NO: 7703 - DNA, 17 bp, Homo sapiens
cagctggcccaggccct

SEQ ID NO: 7704 - DNA, 17 bp, Homo sapiens
agctggcccaggcccta

SEQ ID NO: 7705 - DNA, 17 bp, Homo sapiens
gctggcccaggccctag

SEQ ID NO: 7706 - DNA, 17 bp, Homo sapiens
ctggcccaggccctagg

SEQ ID NO: 7707 - DNA, 17 bp, Homo sapiens
tggcccaggccctaggt

SEQ ID NO: 7708 - DNA, 17 bp, Homo sapiens
ggcccaggccctaggtg

SEQ ID NO: 7709 - DNA, 17 bp, Homo sapiens
gcccaggccctaggtga

SEQ ID NO: 7710 - DNA, 17 bp, Homo sapiens
cccaggccctaggtgag

SEQ ID NO: 7711 - DNA, 17 bp, Homo sapiens
ccaggccctaggtgagt

SEQ ID NO: 7712 - DNA, 17 bp, Homo sapiens
caggccctaggtgagtc

SEQ ID NO: 7713 - DNA, 17 bp, Homo sapiens
aggccctaggtgagtca

SEQ ID NO: 7714 - DNA, 17 bp, Homo sapiens
ggccctaggtgagtcag

SEQ ID NO: 7715 - DNA, 17 bp, Homo sapiens
gccctaggtgagtcagt

SEQ ID NO: 7716 - DNA, 17 bp, Homo sapiens
ccctaggtgagtcagtg

SEQ ID NO: 7717 - DNA, 17 bp, Homo sapiens
cctaggtgagtcagtgt

SEQ ID NO: 7718 - DNA, 17 bp, Homo sapiens
ctaggtgagtcagtgtt

SEQ ID NO: 7719 - DNA, 17 bp, Homo sapiens
taggtgagtcagtgttt

SEQ ID NO: 7720 - DNA, 17 bp, Homo sapiens
aggtgagtcagtgtttg

SEQ ID NO: 7721 - DNA, 17 bp, Homo sapiens
ggtgagtcagtgtttga

SEQ ID NO: 7722 - DNA, 17 bp, Homo sapiens
gtgagtcagtgtttgag

SEQ ID NO: 7723 - DNA, 17 bp, Homo sapiens
tgagtcagtgtttgaga

SEQ ID NO: 7724 - DNA, 17 bp, Homo sapiens
gagtcagtgtttgagaa

SEQ ID NO: 7725 - DNA, 17 bp, Homo sapiens
agtcagtgtttgagaag

SEQ ID NO: 7726 - DNA, 17 bp, Homo sapiens
gtcagtgtttgagaagg

SEQ ID NO: 7727 - DNA, 17 bp, Homo sapiens
tcagtgtttgagaaggg

SEQ ID NO: 7728 - DNA, 17 bp, Homo sapiens
cagtgtttgagaagggt

SEQ ID NO: 7729 - DNA, 17 bp, Homo sapiens
agtgtttgagaagggtc

SEQ ID NO: 7730 - DNA, 17 bp, Homo sapiens
gtgtttgagaagggtct

SEQ ID NO: 7731 - DNA, 17 bp, Homo sapiens
tgtttgagaagggtctc

SEQ ID NO: 7732 - DNA, 17 bp, Homo sapiens
gtttgagaagggtctcc

SEQ ID NO: 7733 - DNA, 17 bp, Homo sapiens
tttgagaagggtctccg

SEQ ID NO: 7734 - DNA, 17 bp, Homo sapiens
ttgagaagggtctccgt

SEQ ID NO: 7735 - DNA, 17 bp, Homo sapiens
tgagaagggtctccgtg

SEQ ID NO: 7736 - DNA, 17 bp, Homo sapiens
gagaagggtctccgtga

SEQ ID NO: 7737 - DNA, 17 bp, Homo sapiens
agaagggtctccgtgag

SEQ ID NO: 7738 - DNA, 17 bp, Homo sapiens
gaagggtctccgtgaga

SEQ ID NO: 7739 - DNA, 17 bp, Homo sapiens
aagggtctccgtgagaa

SEQ ID NO: 7740 - DNA, 17 bp, Homo sapiens
agggtctccgtgagaaa

SEQ ID NO: 7741 - DNA, 17 bp, Homo sapiens
gggtctccgtgagaaag

SEQ ID NO: 7742 - DNA, 17 bp, Homo sapiens
ggtctccgtgagaaagt

SEQ ID NO: 7743 - DNA, 17 bp, Homo sapiens
gtctccgtgagaaagtg

SEQ ID NO: 7744 - DNA, 17 bp, Homo sapiens
tctccgtgagaaagtga

SEQ ID NO: 7745 - DNA, 17 bp, Homo sapiens
ctccgtgagaaagtgac

SEQ ID NO: 7746 - DNA, 17 bp, Homo sapiens
tccgtgagaaagtgacc

SEQ ID NO: 7747 - DNA, 17 bp, Homo sapiens
ccgtgagaaagtgaccc

SEQ ID NO: 7748 - DNA, 17 bp, Homo sapiens
cgtgagaaagtgaccca

SEQ ID NO: 7749 - DNA, 17 bp, Homo sapiens
gtgagaaagtgacccag

SEQ ID NO: 7750 - DNA, 17 bp, Homo sapiens
tgagaaagtgacccagg

SEQ ID NO: 7751 - DNA, 17 bp, Homo sapiens
gagaaagtgacccagga

SEQ ID NO: 7752 - DNA, 17 bp, Homo sapiens
agaaagtgacccaggag

SEQ ID NO: 7753 - DNA, 17 bp, Homo sapiens
gaaagtgacccaggaga

SEQ ID NO: 7754 - DNA, 17 bp, Homo sapiens
aaagtgacccaggagaa

SEQ ID NO: 7755 - DNA, 17 bp, Homo sapiens
aagtgacccaggagaac

SEQ ID NO: 7756 - DNA, 17 bp, Homo sapiens
agtgacccaggagaaca

SEQ ID NO: 7757 - DNA, 17 bp, Homo sapiens
gtgacccaggagaacac

SEQ ID NO: 7758 - DNA, 17 bp, Homo sapiens
tgacccaggagaacacc

SEQ ID NO: 7759 - DNA, 17 bp, Homo sapiens
gacccaggagaacacca

SEQ ID NO: 7760 - DNA, 17 bp, Homo sapiens
acccaggagaacaccag

SEQ ID NO: 7761 - DNA, 17 bp, Homo sapiens
cccaggagaacaccagt

SEQ ID NO: 7762 - DNA, 17 bp, Homo sapiens
ccaggagaacaccagtg

SEQ ID NO: 7763 - DNA, 17 bp, Homo sapiens
caggagaacaccagtgt

SEQ ID NO: 7764 - DNA, 17 bp, Homo sapiens
aggagaacaccagtgtc

SEQ ID NO: 7765 - DNA, 17 bp, Homo sapiens
ggagaacaccagtgtcc

SEQ ID NO: 7766 - DNA, 17 bp, Homo sapiens
gagaacaccagtgtccg

SEQ ID NO: 7767 - DNA, 17 bp, Homo sapiens
agaacaccagtgtccgg

SEQ ID NO: 7768 - DNA, 17 bp, Homo sapiens
gaacaccagtgtccggt

SEQ ID NO: 7769 - DNA, 17 bp, Homo sapiens
aacaccagtgtccggtg

SEQ ID NO: 7770 - DNA, 17 bp, Homo sapiens
acaccagtgtccggtgg

SEQ ID NO: 7771 - DNA, 17 bp, Homo sapiens
caccagtgtccggtggg

SEQ ID NO: 7772 - DNA, 17 bp, Homo sapiens
accagtgtccggtggga

SEQ ID NO: 7773 - DNA, 17 bp, Homo sapiens
ccagtgtccggtgggag

SEQ ID NO: 7774 - DNA, 17 bp, Homo sapiens
cagtgtccggtgggagc

SEQ ID NO: 7775 - DNA, 17 bp, Homo sapiens
agtgtccggtgggagct

SEQ ID NO: 7776 - DNA, 17 bp, Homo sapiens
gtgtccggtgggagcta

SEQ ID NO: 7777 - DNA, 17 bp, Homo sapiens
tgtccggtgggagctag

SEQ ID NO: 7778 - DNA, 17 bp, Homo sapiens
gtccggtgggagctagg

SEQ ID NO: 7779 - DNA, 17 bp, Homo sapiens
tccggtgggagctaggc

SEQ ID NO: 7780 - DNA, 17 bp, Homo sapiens
ccggtgggagctaggcc

SEQ ID NO: 7781 - DNA, 17 bp, Homo sapiens
cggtgggagctaggcca

SEQ ID NO: 7782 - DNA, 17 bp, Homo sapiens
ggtgggagctaggccag

SEQ ID NO: 7783 - DNA, 17 bp, Homo sapiens
gtgggagctaggccagc

SEQ ID NO: 7784 - DNA, 17 bp, Homo sapiens
tgggagctaggccagct

SEQ ID NO: 7785 - DNA, 17 bp, Homo sapiens
gggagctaggccagctt

SEQ ID NO: 7786 - DNA, 17 bp, Homo sapiens
ggagctaggccagcttc

SEQ ID NO: 7787 - DNA, 17 bp, Homo sapiens
gagctaggccagcttca

SEQ ID NO: 7788 - DNA, 17 bp, Homo sapiens
agctaggccagcttcag

SEQ ID NO: 7789 - DNA, 17 bp, Homo sapiens
gctaggccagcttcagc

SEQ ID NO: 7790 - DNA, 17 bp, Homo sapiens
ctaggccagcttcagca

SEQ ID NO: 7791 - DNA, 17 bp, Homo sapiens
taggccagcttcagcag

SEQ ID NO: 7792 - DNA, 17 bp, Homo sapiens
aggccagcttcagcagc

SEQ ID NO: 7793 - DNA, 17 bp, Homo sapiens
ggccagcttcagcagca

SEQ ID NO: 7794 - DNA, 17 bp, Homo sapiens
gccagcttcagcagcag

SEQ ID NO: 7795 - DNA, 17 bp, Homo sapiens
ccagcttcagcagcagc

SEQ ID NO: 7796 - DNA, 17 bp, Homo sapiens
cagcttcagcagcagct

SEQ ID NO: 7797 - DNA, 17 bp, Homo sapiens
agcttcagcagcagctg

SEQ ID NO: 7798 - DNA, 17 bp, Homo sapiens
gcttcagcagcagctga

SEQ ID NO: 7799 - DNA, 17 bp, Homo sapiens
cttcagcagcagctgaa

SEQ ID NO: 7800 - DNA, 17 bp, Homo sapiens
ttcagcagcagctgaag

SEQ ID NO: 7801 - DNA, 17 bp, Homo sapiens
tcagcagcagctgaagc

SEQ ID NO: 7802 - DNA, 17 bp, Homo sapiens
cagcagcagctgaagca

SEQ ID NO: 7803 - DNA, 17 bp, Homo sapiens
agcagcagctgaagcaa

SEQ ID NO: 7804 - DNA, 17 bp, Homo sapiens
gcagcagctgaagcaaa

SEQ ID NO: 7805 - DNA, 17 bp, Homo sapiens
cagcagctgaagcaaaa

SEQ ID NO: 7806 - DNA, 17 bp, Homo sapiens
agcagctgaagcaaaag

SEQ ID NO: 7807 - DNA, 17 bp, Homo sapiens
gcagctgaagcaaaagg

SEQ ID NO: 7808 - DNA, 17 bp, Homo sapiens
cagctgaagcaaaagga

SEQ ID NO: 7809 - DNA, 17 bp, Homo sapiens
agctgaagcaaaaggag

SEQ ID NO: 7810 - DNA, 17 bp, Homo sapiens
gctgaagcaaaaggagc

SEQ ID NO: 7811 - DNA, 17 bp, Homo sapiens
ctgaagcaaaaggagca

SEQ ID NO: 7812 - DNA, 17 bp, Homo sapiens
tgaagcaaaaggagcag

SEQ ID NO: 7813 - DNA, 17 bp, Homo sapiens
gaagcaaaaggagcagg

SEQ ID NO: 7814 - DNA, 17 bp, Homo sapiens
aagcaaaaggagcagga

SEQ ID NO: 7815 - DNA, 17 bp, Homo sapiens
agcaaaaggagcaggaa

SEQ ID NO: 7816 - DNA, 17 bp, Homo sapiens
gcaaaaggagcaggaag

SEQ ID NO: 7817 - DNA, 17 bp, Homo sapiens
caaaaggagcaggaagc

SEQ ID NO: 7818 - DNA, 17 bp, Homo sapiens
aaaaggagcaggaagcc

SEQ ID NO: 7819 - DNA, 17 bp, Homo sapiens
aaaggagcaggaagcct

SEQ ID NO: 7820 - DNA, 17 bp, Homo sapiens
aaggagcaggaagcctc

SEQ ID NO: 7821 - DNA, 17 bp, Homo sapiens
aggagcaggaagcctca

SEQ ID NO: 7822 - DNA, 17 bp, Homo sapiens
ggagcaggaagcctcac

SEQ ID NO: 7823 - DNA, 17 bp, Homo sapiens
gagcaggaagcctcaca

SEQ ID NO: 7824 - DNA, 17 bp, Homo sapiens
agcaggaagcctcacag

SEQ ID NO: 7825 - DNA, 17 bp, Homo sapiens
gcaggaagcctcacagc

SEQ ID NO: 7826 - DNA, 17 bp, Homo sapiens
caggaagcctcacagct

SEQ ID NO: 7827 - DNA, 17 bp, Homo sapiens
aggaagcctcacagctg

SEQ ID NO: 7828 - DNA, 17 bp, Homo sapiens
ggaagcctcacagctga

SEQ ID NO: 7829 - DNA, 17 bp, Homo sapiens
gaagcctcacagctgaa

SEQ ID NO: 7830 - DNA, 17 bp, Homo sapiens
aagcctcacagctgaag

SEQ ID NO: 7831 - DNA, 17 bp, Homo sapiens
agcctcacagctgaagc

SEQ ID NO: 7832 - DNA, 17 bp, Homo sapiens
gcctcacagctgaagca

SEQ ID NO: 7833 - DNA, 17 bp, Homo sapiens
cctcacagctgaagcag

SEQ ID NO: 7834 - DNA, 17 bp, Homo sapiens
ctcacagctgaagcagc

SEQ ID NO: 7835 - DNA, 17 bp, Homo sapiens
tcacagctgaagcagca

SEQ ID NO: 7836 - DNA, 17 bp, Homo sapiens
cacagctgaagcagcag

SEQ ID NO: 7837 - DNA, 17 bp, Homo sapiens
acagctgaagcagcagg

SEQ ID NO: 7838 - DNA, 17 bp, Homo sapiens
cagctgaagcagcaggt

SEQ ID NO: 7839 - DNA, 17 bp, Homo sapiens
agctgaagcagcaggtg

SEQ ID NO: 7840 - DNA, 17 bp, Homo sapiens
gctgaagcagcaggtgg

SEQ ID NO: 7841 - DNA, 17 bp, Homo sapiens
ctgaagcagcaggtgga

SEQ ID NO: 7842 - DNA, 17 bp, Homo sapiens
tgaagcagcaggtggag

SEQ ID NO: 7843 - DNA, 17 bp, Homo sapiens
gaagcagcaggtggaga

SEQ ID NO: 7844 - DNA, 17 bp, Homo sapiens
aagcagcaggtggagat

SEQ ID NO: 7845 - DNA, 17 bp, Homo sapiens
agcagcaggtggagatg

SEQ ID NO: 7846 - DNA, 17 bp, Homo sapiens
gcagcaggtggagatgc

SEQ ID NO: 7847 - DNA, 17 bp, Homo sapiens
cagcaggtggagatgct

SEQ ID NO: 7848 - DNA, 17 bp, Homo sapiens
agcaggtggagatgcta

SEQ ID NO: 7849 - DNA, 17 bp, Homo sapiens
gcaggtggagatgctac

SEQ ID NO: 7850 - DNA, 17 bp, Homo sapiens
caggtggagatgctaca

SEQ ID NO: 7851 - DNA, 17 bp, Homo sapiens
aggtggagatgctacag

SEQ ID NO: 7852 - DNA, 17 bp, Homo sapiens
ggtggagatgctacagg

SEQ ID NO: 7853 - DNA, 17 bp, Homo sapiens
gtggagatgctacagga

SEQ ID NO: 7854 - DNA, 17 bp, Homo sapiens
tggagatgctacaggac

SEQ ID NO: 7855 - DNA, 17 bp, Homo sapiens
ggagatgctacaggacc

SEQ ID NO: 7856 - DNA, 17 bp, Homo sapiens
gagatgctacaggacca

SEQ ID NO: 7857 - DNA, 17 bp, Homo sapiens
agatgctacaggaccat

SEQ ID NO: 7858 - DNA, 17 bp, Homo sapiens
gatgctacaggaccata

SEQ ID NO: 7859 - DNA, 17 bp, Homo sapiens
atgctacaggaccataa

SEQ ID NO: 7860 - DNA, 17 bp, Homo sapiens
tgctacaggaccataaa

SEQ ID NO: 7861 - DNA, 17 bp, Homo sapiens
gctacaggaccataaac

SEQ ID NO: 7862 - DNA, 17 bp, Homo sapiens
ctacaggaccataaacg

SEQ ID NO: 7863 - DNA, 17 bp, Homo sapiens
tacaggaccataaacgg

SEQ ID NO: 7864 - DNA, 17 bp, Homo sapiens
acaggaccataaacggg

SEQ ID NO: 7865 - DNA, 17 bp, Homo sapiens
caggaccataaacggga

SEQ ID NO: 7866 - DNA, 17 bp, Homo sapiens
aggaccataaacgggag

SEQ ID NO: 7867 - DNA, 17 bp, Homo sapiens
ggaccataaacgggagc

SEQ ID NO: 7868 - DNA, 17 bp, Homo sapiens
gaccataaacgggagct

SEQ ID NO: 7869 - DNA, 17 bp, Homo sapiens
accataaacgggagctg

SEQ ID NO: 7870 - DNA, 17 bp, Homo sapiens
ccataaacgggagctgc

SEQ ID NO: 7871 - DNA, 17 bp, Homo sapiens
cataaacgggagctgct

SEQ ID NO: 7872 - DNA, 17 bp, Homo sapiens
ataaacgggagctgctg

SEQ ID NO: 7873 - DNA, 17 bp, Homo sapiens
taaacgggagctgctgg

SEQ ID NO: 7874 - DNA, 17 bp, Homo sapiens
aaacgggagctgctggg

SEQ ID NO: 7875 - DNA, 17 bp, Homo sapiens
aacgggagctgctgggg

SEQ ID NO: 7876 - DNA, 17 bp, Homo sapiens
acgggagctgctggggt

SEQ ID NO: 7877 - DNA, 17 bp, Homo sapiens
cgggagctgctggggtc

SEQ ID NO: 7878 - DNA, 17 bp, Homo sapiens
gggagctgctggggtca

SEQ ID NO: 7879 - DNA, 17 bp, Homo sapiens
ggagctgctggggtcac

SEQ ID NO: 7880 - DNA, 17 bp, Homo sapiens
gagctgctggggtcacc

SEQ ID NO: 7881 - DNA, 17 bp, Homo sapiens
agctgctggggtcaccc

SEQ ID NO: 7882 - DNA, 17 bp, Homo sapiens
gctgctggggtcaccct

SEQ ID NO: 7883 - DNA, 17 bp, Homo sapiens
ctgctggggtcaccctc

SEQ ID NO: 7884 - DNA, 17 bp, Homo sapiens
tgctggggtcaccctct

SEQ ID NO: 7885 - DNA, 17 bp, Homo sapiens
gctggggtcaccctctc

SEQ ID NO: 7886 - DNA, 17 bp, Homo sapiens
ctggggtcaccctctct

SEQ ID NO: 7887 - DNA, 17 bp, Homo sapiens
tggggtcaccctctctg

SEQ ID NO: 7888 - DNA, 17 bp, Homo sapiens
ggggtcaccctctctgg

SEQ ID NO: 7889 - DNA, 17 bp, Homo sapiens
gggtcaccctctctggg

SEQ ID NO: 7890 - DNA, 17 bp, Homo sapiens
ggtcaccctctctgggg

SEQ ID NO: 7891 - DNA, 17 bp, Homo sapiens
gtcaccctctctggggg

SEQ ID NO: 7892 - DNA, 17 bp, Homo sapiens
tcaccctctctggggga

SEQ ID NO: 7893 - DNA, 17 bp, Homo sapiens
caccctctctgggggaa

SEQ ID NO: 7894 - DNA, 17 bp, Homo sapiens
accctctctgggggaaa

SEQ ID NO: 7895 - DNA, 17 bp, Homo sapiens
ccctctctgggggaaaa

SEQ ID NO: 7896 - DNA, 17 bp, Homo sapiens
cctctctgggggaaaat

SEQ ID NO: 7897 - DNA, 17 bp, Homo sapiens
ctctctgggggaaaatt

SEQ ID NO: 7898 - DNA, 17 bp, Homo sapiens
tctctgggggaaaattg

SEQ ID NO: 7899 - DNA, 17 bp, Homo sapiens
ctctgggggaaaattgc

SEQ ID NO: 7900 - DNA, 17 bp, Homo sapiens
tctgggggaaaattgcg

SEQ ID NO: 7901 - DNA, 17 bp, Homo sapiens
ctgggggaaaattgcgt

SEQ ID NO: 7902 - DNA, 17 bp, Homo sapiens
tgggggaaaattgcgtt

SEQ ID NO: 7903 - DNA, 17 bp, Homo sapiens
gggggaaaattgcgttg

SEQ ID NO: 7904 - DNA, 17 bp, Homo sapiens
ggggaaaattgcgttgc

SEQ ID NO: 7905 - DNA, 17 bp, Homo sapiens
gggaaaattgcgttgct

SEQ ID NO: 7906 - DNA, 17 bp, Homo sapiens
ggaaaattgcgttgctg

SEQ ID NO: 7907 - DNA, 17 bp, Homo sapiens
gaaaattgcgttgctgg

SEQ ID NO: 7908 - DNA, 17 bp, Homo sapiens
aaaattgcgttgctggc

SEQ ID NO: 7909 - DNA, 17 bp, Homo sapiens
aaattgcgttgctggct

SEQ ID NO: 7910 - DNA, 17 bp, Homo sapiens
aattgcgttgctggctt

SEQ ID NO: 7911 - DNA, 17 bp, Homo sapiens
attgcgttgctggcttg

SEQ ID NO: 7912 - DNA, 17 bp, Homo sapiens
ttgcgttgctggcttga

SEQ ID NO: 7913 - DNA, 17 bp, Homo sapiens
tgcgttgctggcttgaa

SEQ ID NO: 7914 - DNA, 17 bp, Homo sapiens
gcgttgctggcttgaag

SEQ ID NO: 7915 - DNA, 17 bp, Homo sapiens
cgttgctggcttgaagg

SEQ ID NO: 7916 - DNA, 17 bp, Homo sapiens
gttgctggcttgaagga

SEQ ID NO: 7917 - DNA, 17 bp, Homo sapiens
ttgctggcttgaaggag

SEQ ID NO: 7918 - DNA, 17 bp, Homo sapiens
tgctggcttgaaggaga

SEQ ID NO: 7919 - DNA, 17 bp, Homo sapiens
gctggcttgaaggagag

SEQ ID NO: 7920 - DNA, 17 bp, Homo sapiens
ctggcttgaaggagagg

SEQ ID NO: 7921 - DNA, 17 bp, Homo sapiens
tggcttgaaggagaggc

SEQ ID NO: 7922 - DNA, 17 bp, Homo sapiens
ggcttgaaggagaggct

SEQ ID NO: 7923 - DNA, 17 bp, Homo sapiens
gcttgaaggagaggctc

SEQ ID NO: 7924 - DNA, 17 bp, Homo sapiens
cttgaaggagaggctct

SEQ ID NO: 7925 - DNA, 17 bp, Homo sapiens
ttgaaggagaggctctg

SEQ ID NO: 7926 - DNA, 17 bp, Homo sapiens
tgaaggagaggctctgg

SEQ ID NO: 7927 - DNA, 17 bp, Homo sapiens
gaaggagaggctctgga

SEQ ID NO: 7928 - DNA, 17 bp, Homo sapiens
aaggagaggctctggaa

SEQ ID NO: 7929 - DNA, 17 bp, Homo sapiens
aggagaggctctggaag

SEQ ID NO: 7930 - DNA, 17 bp, Homo sapiens
ggagaggctctggaagt

SEQ ID NO: 7931 - DNA, 17 bp, Homo sapiens
gagaggctctggaagtt

SEQ ID NO: 7932 - DNA, 17 bp, Homo sapiens
agaggctctggaagttg

SEQ ID NO: 7933 - DNA, 17 bp, Homo sapiens
gaggctctggaagttgg

SEQ ID NO: 7934 - DNA, 17 bp, Homo sapiens
aggctctggaagttgga

SEQ ID NO: 7935 - DNA, 17 bp, Homo sapiens
ggctctggaagttggaa

SEQ ID NO: 7936 - DNA, 17 bp, Homo sapiens
gctctggaagttggaat

SEQ ID NO: 7937 - DNA, 17 bp, Homo sapiens
ctctggaagttggaatc

SEQ ID NO: 7938 - DNA, 17 bp, Homo sapiens
tctggaagttggaatcc

SEQ ID NO: 7939 - DNA, 17 bp, Homo sapiens
ctggaagttggaatcca

SEQ ID NO: 7940 - DNA, 17 bp, Homo sapiens
tggaagttggaatccag

SEQ ID NO: 7941 - DNA, 17 bp, Homo sapiens
ggaagttggaatccagc

SEQ ID NO: 7942 - DNA, 17 bp, Homo sapiens
gaagttggaatccagcg

SEQ ID NO: 7943 - DNA, 17 bp, Homo sapiens
aagttggaatccagcgc

SEQ ID NO: 7944 - DNA, 17 bp, Homo sapiens
agttggaatccagcgcc

SEQ ID NO: 7945 - DNA, 17 bp, Homo sapiens
gttggaatccagcgccc

SEQ ID NO: 7946 - DNA, 17 bp, Homo sapiens
ttggaatccagcgccct

SEQ ID NO: 7947 - DNA, 17 bp, Homo sapiens
tggaatccagcgccctt

SEQ ID NO: 7948 - DNA, 17 bp, Homo sapiens
ggaatccagcgcccttg

SEQ ID NO: 7949 - DNA, 17 bp, Homo sapiens
gaatccagcgcccttga

SEQ ID NO: 7950 - DNA, 17 bp, Homo sapiens
aatccagcgcccttgag

SEQ ID NO: 7951 - DNA, 17 bp, Homo sapiens
atccagcgcccttgagc

SEQ ID NO: 7952 - DNA, 17 bp, Homo sapiens
tccagcgcccttgagca

SEQ ID NO: 7953 - DNA, 17 bp, Homo sapiens
ccagcgcccttgagcaa

SEQ ID NO: 7954 - DNA, 17 bp, Homo sapiens
cagcgcccttgagcaac

SEQ ID NO: 7955 - DNA, 17 bp, Homo sapiens
agcgcccttgagcaaca

SEQ ID NO: 7956 - DNA, 17 bp, Homo sapiens
gcgcccttgagcaacag

SEQ ID NO: 7957 - DNA, 17 bp, Homo sapiens
cgcccttgagcaacaga

SEQ ID NO: 7958 - DNA, 17 bp, Homo sapiens
gcccttgagcaacagaa

SEQ ID NO: 7959 - DNA, 17 bp, Homo sapiens
cccttgagcaacagaaa

SEQ ID NO: 7960 - DNA, 17 bp, Homo sapiens
ccttgagcaacagaaaa

SEQ ID NO: 7961 - DNA, 17 bp, Homo sapiens
cttgagcaacagaaaat

SEQ ID NO: 7962 - DNA, 17 bp, Homo sapiens
ttgagcaacagaaaatc

SEQ ID NO: 7963 - DNA, 17 bp, Homo sapiens
tgagcaacagaaaatcc

SEQ ID NO: 7964 - DNA, 17 bp, Homo sapiens
gagcaacagaaaatcca

SEQ ID NO: 7965 - DNA, 17 bp, Homo sapiens
agcaacagaaaatccag

SEQ ID NO: 7966 - DNA, 17 bp, Homo sapiens
gcaacagaaaatccaga

SEQ ID NO: 7967 - DNA, 17 bp, Homo sapiens
caacagaaaatccagag

SEQ ID NO: 7968 - DNA, 17 bp, Homo sapiens
aacagaaaatccagagc

SEQ ID NO: 7969 - DNA, 17 bp, Homo sapiens
acagaaaatccagagcc

SEQ ID NO: 7970 - DNA, 17 bp, Homo sapiens
cagaaaatccagagcca

SEQ ID NO: 7971 - DNA, 17 bp, Homo sapiens
agaaaatccagagccag

SEQ ID NO: 7972 - DNA, 17 bp, Homo sapiens
gaaaatccagagccagc

SEQ ID NO: 7973 - DNA, 17 bp, Homo sapiens
aaaatccagagccagca

SEQ ID NO: 7974 - DNA, 17 bp, Homo sapiens
aaatccagagccagcag

SEQ ID NO: 7975 - DNA, 17 bp, Homo sapiens
aatccagagccagcagg

SEQ ID NO: 7976 - DNA, 17 bp, Homo sapiens
atccagagccagcagga

SEQ ID NO: 7977 - DNA, 17 bp, Homo sapiens
tccagagccagcaggaa

SEQ ID NO: 7978 - DNA, 17 bp, Homo sapiens
ccagagccagcaggaaa

SEQ ID NO: 7979 - DNA, 17 bp, Homo sapiens
cagagccagcaggaaaa

SEQ ID NO: 7980 - DNA, 17 bp, Homo sapiens
agagccagcaggaaaac

SEQ ID NO: 7981 - DNA, 17 bp, Homo sapiens
gagccagcaggaaaaca

SEQ ID NO: 7982 - DNA, 17 bp, Homo sapiens
agccagcaggaaaacac

SEQ ID NO: 7983 - DNA, 17 bp, Homo sapiens
gccagcaggaaaacacc

SEQ ID NO: 7984 - DNA, 17 bp, Homo sapiens
ccagcaggaaaacacca

SEQ ID NO: 7985 - DNA, 17 bp, Homo sapiens
cagcaggaaaacaccat

SEQ ID NO: 7986 - DNA, 17 bp, Homo sapiens
agcaggaaaacaccatc

SEQ ID NO: 7987 - DNA, 17 bp, Homo sapiens
gcaggaaaacaccatca

SEQ ID NO: 7988 - DNA, 17 bp, Homo sapiens
caggaaaacaccatcaa

SEQ ID NO: 7989 - DNA, 17 bp, Homo sapiens
aggaaaacaccatcaag

SEQ ID NO: 7990 - DNA, 17 bp, Homo sapiens
ggaaaacaccatcaagc

SEQ ID NO: 7991 - DNA, 17 bp, Homo sapiens
gaaaacaccatcaagca

SEQ ID NO: 7992 - DNA, 17 bp, Homo sapiens
aaaacaccatcaagcag

SEQ ID NO: 7993 - DNA, 17 bp, Homo sapiens
aaacaccatcaagcagc

SEQ ID NO: 7994 - DNA, 17 bp, Homo sapiens
aacaccatcaagcagct

SEQ ID NO: 7995 - DNA, 17 bp, Homo sapiens
acaccatcaagcagctg

SEQ ID NO: 7996 - DNA, 17 bp, Homo sapiens
caccatcaagcagctgg

SEQ ID NO: 7997 - DNA, 17 bp, Homo sapiens
accatcaagcagctgga

SEQ ID NO: 7998 - DNA, 17 bp, Homo sapiens
ccatcaagcagctggag

SEQ ID NO: 7999 - DNA, 17 bp, Homo sapiens
catcaagcagctggagc

SEQ ID NO: 8000 - DNA, 17 bp, Homo sapiens
atcaagcagctggagca

SEQ ID NO: 8001 - DNA, 17 bp, Homo sapiens
tcaagcagctggagcag

SEQ ID NO: 8002 - DNA, 17 bp, Homo sapiens
caagcagctggagcagc

SEQ ID NO: 8003 - DNA, 17 bp, Homo sapiens
aagcagctggagcagct

SEQ ID NO: 8004 - DNA, 17 bp, Homo sapiens
agcagctggagcagctc

SEQ ID NO: 8005 - DNA, 17 bp, Homo sapiens
gcagctggagcagctcc

SEQ ID NO: 8006 - DNA, 17 bp, Homo sapiens
cagctggagcagctccg

SEQ ID NO: 8007 - DNA, 17 bp, Homo sapiens
agctggagcagctccgc

SEQ ID NO: 8008 - DNA, 17 bp, Homo sapiens
gctggagcagctccgcc

SEQ ID NO: 8009 - DNA, 17 bp, Homo sapiens
ctggagcagctccgcca

SEQ ID NO: 8010 - DNA, 17 bp, Homo sapiens
tggagcagctccgccag

SEQ ID NO: 8011 - DNA, 17 bp, Homo sapiens
ggagcagctccgccagc

SEQ ID NO: 8012 - DNA, 17 bp, Homo sapiens
gagcagctccgccagcg

SEQ ID NO: 8013 - DNA, 17 bp, Homo sapiens
agcagctccgccagcgg

SEQ ID NO: 8014 - DNA, 17 bp, Homo sapiens
gcagctccgccagcggt

SEQ ID NO: 8015 - DNA, 17 bp, Homo sapiens
cagctccgccagcggtt

SEQ ID NO: 8016 - DNA, 17 bp, Homo sapiens
agctccgccagcggttt

SEQ ID NO: 8017 - DNA, 17 bp, Homo sapiens
gctccgccagcggtttg

SEQ ID NO: 8018 - DNA, 17 bp, Homo sapiens
ctccgccagcggtttga

SEQ ID NO: 8019 - DNA, 17 bp, Homo sapiens
tccgccagcggtttgag

SEQ ID NO: 8020 - DNA, 17 bp, Homo sapiens
ccgccagcggtttgagc

SEQ ID NO: 8021 - DNA, 17 bp, Homo sapiens
cgccagcggtttgagct

SEQ ID NO: 8022 - DNA, 17 bp, Homo sapiens
gccagcggtttgagctg

SEQ ID NO: 8023 - DNA, 17 bp, Homo sapiens
ccagcggtttgagctgg

SEQ ID NO: 8024 - DNA, 17 bp, Homo sapiens
cagcggtttgagctgga

SEQ ID NO: 8025 - DNA, 17 bp, Homo sapiens
agcggtttgagctggag

SEQ ID NO: 8026 - DNA, 17 bp, Homo sapiens
gcggtttgagctggaga

SEQ ID NO: 8027 - DNA, 17 bp, Homo sapiens
cggtttgagctggagat

SEQ ID NO: 8028 - DNA, 17 bp, Homo sapiens
ggtttgagctggagatc

SEQ ID NO: 8029 - DNA, 17 bp, Homo sapiens
gtttgagctggagatcg

SEQ ID NO: 8030 - DNA, 17 bp, Homo sapiens
tttgagctggagatcga

SEQ ID NO: 8031 - DNA, 17 bp, Homo sapiens
ttgagctggagatcgag

SEQ ID NO: 8032 - DNA, 17 bp, Homo sapiens
tgagctggagatcgagc

SEQ ID NO: 8033 - DNA, 17 bp, Homo sapiens
gagctggagatcgagcg

SEQ ID NO: 8034 - DNA, 17 bp, Homo sapiens
agctggagatcgagcgg

SEQ ID NO: 8035 - DNA, 17 bp, Homo sapiens
gctggagatcgagcgga

SEQ ID NO: 8036 - DNA, 17 bp, Homo sapiens
ctggagatcgagcggat

SEQ ID NO: 8037 - DNA, 17 bp, Homo sapiens
tggagatcgagcggatg

SEQ ID NO: 8038 - DNA, 17 bp, Homo sapiens
ggagatcgagcggatga

SEQ ID NO: 8039 - DNA, 17 bp, Homo sapiens
gagatcgagcggatgaa

SEQ ID NO: 8040 - DNA, 17 bp, Homo sapiens
agatcgagcggatgaag

SEQ ID NO: 8041 - DNA, 17 bp, Homo sapiens
gatcgagcggatgaagc

SEQ ID NO: 8042 - DNA, 17 bp, Homo sapiens
atcgagcggatgaagca

SEQ ID NO: 8043 - DNA, 17 bp, Homo sapiens
tcgagcggatgaagcag

SEQ ID NO: 8044 - DNA, 17 bp, Homo sapiens
cgagcggatgaagcaga

SEQ ID NO: 8045 - DNA, 17 bp, Homo sapiens
gagcggatgaagcagat

SEQ ID NO: 8046 - DNA, 17 bp, Homo sapiens
agcggatgaagcagatg

SEQ ID NO: 8047 - DNA, 17 bp, Homo sapiens
gcggatgaagcagatgc

SEQ ID NO: 8048 - DNA, 17 bp, Homo sapiens
cggatgaagcagatgca

SEQ ID NO: 8049 - DNA, 17 bp, Homo sapiens
ggatgaagcagatgcac

SEQ ID NO: 8050 - DNA, 17 bp, Homo sapiens
gatgaagcagatgcacc

SEQ ID NO: 8051 - DNA, 17 bp, Homo sapiens
atgaagcagatgcacca

SEQ ID NO: 8052 - DNA, 17 bp, Homo sapiens
tgaagcagatgcaccag

SEQ ID NO: 8053 - DNA, 17 bp, Homo sapiens
gaagcagatgcaccaga

SEQ ID NO: 8054 - DNA, 17 bp, Homo sapiens
aagcagatgcaccagaa

SEQ ID NO: 8055 - DNA, 17 bp, Homo sapiens
agcagatgcaccagaag

SEQ ID NO: 8056 - DNA, 17 bp, Homo sapiens
gcagatgcaccagaagg

SEQ ID NO: 8057 - DNA, 17 bp, Homo sapiens
cagatgcaccagaagga

SEQ ID NO: 8058 - DNA, 17 bp, Homo sapiens
agatgcaccagaaggac

SEQ ID NO: 8059 - DNA, 17 bp, Homo sapiens
gatgcaccagaaggacc

SEQ ID NO: 8060 - DNA, 17 bp, Homo sapiens
atgcaccagaaggaccg

SEQ ID NO: 8061 - DNA, 17 bp, Homo sapiens
tgcaccagaaggaccgt

SEQ ID NO: 8062 - DNA, 17 bp, Homo sapiens
gcaccagaaggaccgtg

SEQ ID NO: 8063 - DNA, 17 bp, Homo sapiens
caccagaaggaccgtga

SEQ ID NO: 8064 - DNA, 17 bp, Homo sapiens
accagaaggaccgtgag

SEQ ID NO: 8065 - DNA, 17 bp, Homo sapiens
ccagaaggaccgtgagg

SEQ ID NO: 8066 - DNA, 17 bp, Homo sapiens
cagaaggaccgtgagga

SEQ ID NO: 8067 - DNA, 17 bp, Homo sapiens
agaaggaccgtgaggac

SEQ ID NO: 8068 - DNA, 17 bp, Homo sapiens
gaaggaccgtgaggacc

SEQ ID NO: 8069 - DNA, 17 bp, Homo sapiens
aaggaccgtgaggacca

SEQ ID NO: 8070 - DNA, 17 bp, Homo sapiens
aggaccgtgaggaccag

SEQ ID NO: 8071 - DNA, 17 bp, Homo sapiens
ggaccgtgaggaccagg

SEQ ID NO: 8072 - DNA, 17 bp, Homo sapiens
gaccgtgaggaccagga

SEQ ID NO: 8073 - DNA, 17 bp, Homo sapiens
accgtgaggaccaggag

SEQ ID NO: 8074 - DNA, 17 bp, Homo sapiens
ccgtgaggaccaggagg

SEQ ID NO: 8075 - DNA, 17 bp, Homo sapiens
cgtgaggaccaggagga

SEQ ID NO: 8076 - DNA, 17 bp, Homo sapiens
gtgaggaccaggaggag

SEQ ID NO: 8077 - DNA, 17 bp, Homo sapiens
tgaggaccaggaggagg

SEQ ID NO: 8078 - DNA, 17 bp, Homo sapiens
gaggaccaggaggagga

SEQ ID NO: 8079 - DNA, 17 bp, Homo sapiens
aggaccaggaggaggaa

SEQ ID NO: 8080 - DNA, 17 bp, Homo sapiens
ggaccaggaggaggaac

SEQ ID NO: 8081 - DNA, 17 bp, Homo sapiens
gaccaggaggaggaact

SEQ ID NO: 8082 - DNA, 17 bp, Homo sapiens
accaggaggaggaactg

SEQ ID NO: 8083 - DNA, 17 bp, Homo sapiens
ccaggaggaggaactgg

SEQ ID NO: 8084 - DNA, 17 bp, Homo sapiens
caggaggaggaactgga

SEQ ID NO: 8085 - DNA, 17 bp, Homo sapiens
aggaggaggaactggag

SEQ ID NO: 8086 - DNA, 17 bp, Homo sapiens
ggaggaggaactggagg

SEQ ID NO: 8087 - DNA, 17 bp, Homo sapiens
gaggaggaactggagga

SEQ ID NO: 8088 - DNA, 17 bp, Homo sapiens
aggaggaactggaggat

SEQ ID NO: 8089 - DNA, 17 bp, Homo sapiens
ggaggaactggaggatg

SEQ ID NO: 8090 - DNA, 17 bp, Homo sapiens
gaggaactggaggatgt

SEQ ID NO: 8091 - DNA, 17 bp, Homo sapiens
aggaactggaggatgtc

SEQ ID NO: 8092 - DNA, 17 bp, Homo sapiens
ggaactggaggatgtcc

SEQ ID NO: 8093 - DNA, 17 bp, Homo sapiens
gaactggaggatgtccg

SEQ ID NO: 8094 - DNA, 17 bp, Homo sapiens
aactggaggatgtccgt

SEQ ID NO: 8095 - DNA, 17 bp, Homo sapiens
actggaggatgtccgtc

SEQ ID NO: 8096 - DNA, 17 bp, Homo sapiens
ctggaggatgtccgtca

SEQ ID NO: 8097 - DNA, 17 bp, Homo sapiens
tggaggatgtccgtcag

SEQ ID NO: 8098 - DNA, 17 bp, Homo sapiens
ggaggatgtccgtcagt

SEQ ID NO: 8099 - DNA, 17 bp, Homo sapiens
gaggatgtccgtcagtc

SEQ ID NO: 8100 - DNA, 17 bp, Homo sapiens
aggatgtccgtcagtcc

SEQ ID NO: 8101 - DNA, 17 bp, Homo sapiens
ggatgtccgtcagtcct

SEQ ID NO: 8102 - DNA, 17 bp, Homo sapiens
gatgtccgtcagtcctg

SEQ ID NO: 8103 - DNA, 17 bp, Homo sapiens
atgtccgtcagtcctgc

SEQ ID NO: 8104 - DNA, 17 bp, Homo sapiens
tgtccgtcagtcctgcc

SEQ ID NO: 8105 - DNA, 17 bp, Homo sapiens
gtccgtcagtcctgcca

SEQ ID NO: 8106 - DNA, 17 bp, Homo sapiens
tccgtcagtcctgccag

SEQ ID NO: 8107 - DNA, 17 bp, Homo sapiens
ccgtcagtcctgccaga

SEQ ID NO: 8108 - DNA, 17 bp, Homo sapiens
cgtcagtcctgccagaa

SEQ ID NO: 8109 - DNA, 17 bp, Homo sapiens
gtcagtcctgccagaag

SEQ ID NO: 8110 - DNA, 17 bp, Homo sapiens
tcagtcctgccagaagc

SEQ ID NO: 8111 - DNA, 17 bp, Homo sapiens
cagtcctgccagaagcg

SEQ ID NO: 8112 - DNA, 17 bp, Homo sapiens
agtcctgccagaagcgg

SEQ ID NO: 8113 - DNA, 17 bp, Homo sapiens
gtcctgccagaagcggc

SEQ ID NO: 8114 - DNA, 17 bp, Homo sapiens
tcctgccagaagcggct

SEQ ID NO: 8115 - DNA, 17 bp, Homo sapiens
cctgccagaagcggctt

SEQ ID NO: 8116 - DNA, 17 bp, Homo sapiens
ctgccagaagcggcttc

SEQ ID NO: 8117 - DNA, 17 bp, Homo sapiens
tgccagaagcggcttca

SEQ ID NO: 8118 - DNA, 17 bp, Homo sapiens
gccagaagcggcttcat

SEQ ID NO: 8119 - DNA, 17 bp, Homo sapiens
ccagaagcggcttcatc

SEQ ID NO: 8120 - DNA, 17 bp, Homo sapiens
cagaagcggcttcatca

SEQ ID NO: 8121 - DNA, 17 bp, Homo sapiens
agaagcggcttcatcag

SEQ ID NO: 8122 - DNA, 17 bp, Homo sapiens
gaagcggcttcatcagc

SEQ ID NO: 8123 - DNA, 17 bp, Homo sapiens
aagcggcttcatcagct

SEQ ID NO: 8124 - DNA, 17 bp, Homo sapiens
agcggcttcatcagctg

SEQ ID NO: 8125 - DNA, 17 bp, Homo sapiens
gcggcttcatcagctgg

SEQ ID NO: 8126 - DNA, 17 bp, Homo sapiens
cggcttcatcagctgga

SEQ ID NO: 8127 - DNA, 17 bp, Homo sapiens
ggcttcatcagctggaa

SEQ ID NO: 8128 - DNA, 17 bp, Homo sapiens
gcttcatcagctggaaa

SEQ ID NO: 8129 - DNA, 17 bp, Homo sapiens
cttcatcagctggaaat

SEQ ID NO: 8130 - DNA, 17 bp, Homo sapiens
ttcatcagctggaaatg

SEQ ID NO: 8131 - DNA, 17 bp, Homo sapiens
tcatcagctggaaatgc

SEQ ID NO: 8132 - DNA, 17 bp, Homo sapiens
catcagctggaaatgca

SEQ ID NO: 8133 - DNA, 17 bp, Homo sapiens
atcagctggaaatgcag

SEQ ID NO: 8134 - DNA, 17 bp, Homo sapiens
tcagctggaaatgcagc

SEQ ID NO: 8135 - DNA, 17 bp, Homo sapiens
cagctggaaatgcagct

SEQ ID NO: 8136 - DNA, 17 bp, Homo sapiens
agctggaaatgcagctg

SEQ ID NO: 8137 - DNA, 17 bp, Homo sapiens
gctggaaatgcagctgg

SEQ ID NO: 8138 - DNA, 17 bp, Homo sapiens
ctggaaatgcagctgga

SEQ ID NO: 8139 - DNA, 17 bp, Homo sapiens
tggaaatgcagctggag

SEQ ID NO: 8140 - DNA, 17 bp, Homo sapiens
ggaaatgcagctggagc

SEQ ID NO: 8141 - DNA, 17 bp, Homo sapiens
gaaatgcagctggagca

SEQ ID NO: 8142 - DNA, 17 bp, Homo sapiens
aaatgcagctggagcaa

SEQ ID NO: 8143 - DNA, 17 bp, Homo sapiens
aatgcagctggagcaag

SEQ ID NO: 8144 - DNA, 17 bp, Homo sapiens
atgcagctggagcaaga

SEQ ID NO: 8145 - DNA, 17 bp, Homo sapiens
tgcagctggagcaagag

SEQ ID NO: 8146 - DNA, 17 bp, Homo sapiens
gcagctggagcaagagt

SEQ ID NO: 8147 - DNA, 17 bp, Homo sapiens
cagctggagcaagagta

SEQ ID NO: 8148 - DNA, 17 bp, Homo sapiens
agctggagcaagagtat

SEQ ID NO: 8149 - DNA, 17 bp, Homo sapiens
gctggagcaagagtatg

SEQ ID NO: 8150 - DNA, 17 bp, Homo sapiens
ctggagcaagagtatga

SEQ ID NO: 8151 - DNA, 17 bp, Homo sapiens
tggagcaagagtatgaa

SEQ ID NO: 8152 - DNA, 17 bp, Homo sapiens
ggagcaagagtatgaag

SEQ ID NO: 8153 - DNA, 17 bp, Homo sapiens
gagcaagagtatgaaga

SEQ ID NO: 8154 - DNA, 17 bp, Homo sapiens
agcaagagtatgaagag

SEQ ID NO: 8155 - DNA, 17 bp, Homo sapiens
gcaagagtatgaagaga

SEQ ID NO: 8156 - DNA, 17 bp, Homo sapiens
caagagtatgaagagaa

SEQ ID NO: 8157 - DNA, 17 bp, Homo sapiens
aagagtatgaagagaag

SEQ ID NO: 8158 - DNA, 17 bp, Homo sapiens
agagtatgaagagaagc

SEQ ID NO: 8159 - DNA, 17 bp, Homo sapiens
gagtatgaagagaagca

SEQ ID NO: 8160 - DNA, 17 bp, Homo sapiens
agtatgaagagaagcag

SEQ ID NO: 8161 - DNA, 17 bp, Homo sapiens
gtatgaagagaagcaga

SEQ ID NO: 8162 - DNA, 17 bp, Homo sapiens
tatgaagagaagcagat

SEQ ID NO: 8163 - DNA, 17 bp, Homo sapiens
atgaagagaagcagatg

SEQ ID NO: 8164 - DNA, 17 bp, Homo sapiens
tgaagagaagcagatgg

SEQ ID NO: 8165 - DNA, 17 bp, Homo sapiens
gaagagaagcagatggt

SEQ ID NO: 8166 - DNA, 17 bp, Homo sapiens
aagagaagcagatggtc

SEQ ID NO: 8167 - DNA, 17 bp, Homo sapiens
agagaagcagatggtcc

SEQ ID NO: 8168 - DNA, 17 bp, Homo sapiens
gagaagcagatggtcct

SEQ ID NO: 8169 - DNA, 17 bp, Homo sapiens
agaagcagatggtcctc

SEQ ID NO: 8170 - DNA, 17 bp, Homo sapiens
gaagcagatggtcctcc

SEQ ID NO: 8171 - DNA, 17 bp, Homo sapiens
aagcagatggtcctcca

SEQ ID NO: 8172 - DNA, 17 bp, Homo sapiens
agcagatggtcctccat

SEQ ID NO: 8173 - DNA, 17 bp, Homo sapiens
gcagatggtcctccatg

SEQ ID NO: 8174 - DNA, 17 bp, Homo sapiens
cagatggtcctccatga

SEQ ID NO: 8175 - DNA, 17 bp, Homo sapiens
agatggtcctccatgag

SEQ ID NO: 8176 - DNA, 17 bp, Homo sapiens
gatggtcctccatgaga

SEQ ID NO: 8177 - DNA, 17 bp, Homo sapiens
atggtcctccatgagaa

SEQ ID NO: 8178 - DNA, 17 bp, Homo sapiens
tggtcctccatgagaag

SEQ ID NO: 8179 - DNA, 17 bp, Homo sapiens
ggtcctccatgagaagc

SEQ ID NO: 8180 - DNA, 17 bp, Homo sapiens
gtcctccatgagaagca

SEQ ID NO: 8181 - DNA, 17 bp, Homo sapiens
tcctccatgagaagcaa

SEQ ID NO: 8182 - DNA, 17 bp, Homo sapiens
cctccatgagaagcaag

SEQ ID NO: 8183 - DNA, 17 bp, Homo sapiens
ctccatgagaagcaaga

SEQ ID NO: 8184 - DNA, 17 bp, Homo sapiens
tccatgagaagcaagat

SEQ ID NO: 8185 - DNA, 17 bp, Homo sapiens
ccatgagaagcaagatt

SEQ ID NO: 8186 - DNA, 17 bp, Homo sapiens
catgagaagcaagattt

SEQ ID NO: 8187 - DNA, 17 bp, Homo sapiens
atgagaagcaagatttg

SEQ ID NO: 8188 - DNA, 17 bp, Homo sapiens
tgagaagcaagatttgg

SEQ ID NO: 8189 - DNA, 17 bp, Homo sapiens
gagaagcaagatttgga

SEQ ID NO: 8190 - DNA, 17 bp, Homo sapiens
agaagcaagatttggaa

SEQ ID NO: 8191 - DNA, 17 bp, Homo sapiens
gaagcaagatttggaag

SEQ ID NO: 8192 - DNA, 17 bp, Homo sapiens
aagcaagatttggaagg

SEQ ID NO: 8193 - DNA, 17 bp, Homo sapiens
agcaagatttggaaggc

SEQ ID NO: 8194 - DNA, 17 bp, Homo sapiens
gcaagatttggaaggct

SEQ ID NO: 8195 - DNA, 17 bp, Homo sapiens
caagatttggaaggctt

SEQ ID NO: 8196 - DNA, 17 bp, Homo sapiens
aagatttggaaggcttg

SEQ ID NO: 8197 - DNA, 17 bp, Homo sapiens
agatttggaaggcttga

SEQ ID NO: 8198 - DNA, 17 bp, Homo sapiens
gatttggaaggcttgat

SEQ ID NO: 8199 - DNA, 17 bp, Homo sapiens
atttggaaggcttgatc

SEQ ID NO: 8200 - DNA, 17 bp, Homo sapiens
tttggaaggcttgatcg

SEQ ID NO: 8201 - DNA, 17 bp, Homo sapiens
ttggaaggcttgatcgg

SEQ ID NO: 8202 - DNA, 17 bp, Homo sapiens
tggaaggcttgatcgga

SEQ ID NO: 8203 - DNA, 17 bp, Homo sapiens
ggaaggcttgatcggaa

SEQ ID NO: 8204 - DNA, 17 bp, Homo sapiens
gaaggcttgatcggaac

SEQ ID NO: 8205 - DNA, 17 bp, Homo sapiens
aaggcttgatcggaacc

SEQ ID NO: 8206 - DNA, 17 bp, Homo sapiens
aggcttgatcggaaccc

SEQ ID NO: 8207 - DNA, 17 bp, Homo sapiens
ggcttgatcggaaccct

SEQ ID NO: 8208 - DNA, 17 bp, Homo sapiens
gcttgatcggaaccctc

SEQ ID NO: 8209 - DNA, 17 bp, Homo sapiens
cttgatcggaaccctct

SEQ ID NO: 8210 - DNA, 17 bp, Homo sapiens
ttgatcggaaccctctg

SEQ ID NO: 8211 - DNA, 17 bp, Homo sapiens
tgatcggaaccctctgt

SEQ ID NO: 8212 - DNA, 17 bp, Homo sapiens
gatcggaaccctctgtg

SEQ ID NO: 8213 - DNA, 17 bp, Homo sapiens
atcggaaccctctgtga

SEQ ID NO: 8214 - DNA, 17 bp, Homo sapiens
tcggaaccctctgtgac

SEQ ID NO: 8215 - DNA, 17 bp, Homo sapiens
cggaaccctctgtgacc

SEQ ID NO: 8216 - DNA, 17 bp, Homo sapiens
ggaaccctctgtgacca

SEQ ID NO: 8217 - DNA, 17 bp, Homo sapiens
gaaccctctgtgaccag

SEQ ID NO: 8218 - DNA, 17 bp, Homo sapiens
aaccctctgtgaccaga

SEQ ID NO: 8219 - DNA, 17 bp, Homo sapiens
accctctgtgaccagat

SEQ ID NO: 8220 - DNA, 17 bp, Homo sapiens
ccctctgtgaccagatt

SEQ ID NO: 8221 - DNA, 17 bp, Homo sapiens
cctctgtgaccagattg

SEQ ID NO: 8222 - DNA, 17 bp, Homo sapiens
ctctgtgaccagattgg

SEQ ID NO: 8223 - DNA, 17 bp, Homo sapiens
tctgtgaccagattggc

SEQ ID NO: 8224 - DNA, 17 bp, Homo sapiens
ctgtgaccagattggcc

SEQ ID NO: 8225 - DNA, 17 bp, Homo sapiens
tgtgaccagattggcca

SEQ ID NO: 8226 - DNA, 17 bp, Homo sapiens
gtgaccagattggccat

SEQ ID NO: 8227 - DNA, 17 bp, Homo sapiens
tgaccagattggccatc

SEQ ID NO: 8228 - DNA, 17 bp, Homo sapiens
gaccagattggccatcg

SEQ ID NO: 8229 - DNA, 17 bp, Homo sapiens
accagattggccatcgg

SEQ ID NO: 8230 - DNA, 17 bp, Homo sapiens
ccagattggccatcggg

SEQ ID NO: 8231 - DNA, 17 bp, Homo sapiens
cagattggccatcggga

SEQ ID NO: 8232 - DNA, 17 bp, Homo sapiens
agattggccatcgggac

SEQ ID NO: 8233 - DNA, 17 bp, Homo sapiens
gattggccatcgggact

SEQ ID NO: 8234 - DNA, 17 bp, Homo sapiens
attggccatcgggactt

SEQ ID NO: 8235 - DNA, 17 bp, Homo sapiens
ttggccatcgggacttt

SEQ ID NO: 8236 - DNA, 17 bp, Homo sapiens
tggccatcgggactttg

SEQ ID NO: 8237 - DNA, 17 bp, Homo sapiens
ggccatcgggactttga

SEQ ID NO: 8238 - DNA, 17 bp, Homo sapiens
gccatcgggactttgat

SEQ ID NO: 8239 - DNA, 17 bp, Homo sapiens
ccatcgggactttgatg

SEQ ID NO: 8240 - DNA, 17 bp, Homo sapiens
catcgggactttgatgt

SEQ ID NO: 8241 - DNA, 17 bp, Homo sapiens
atcgggactttgatgtg

SEQ ID NO: 8242 - DNA, 17 bp, Homo sapiens
tcgggactttgatgtgg

SEQ ID NO: 8243 - DNA, 17 bp, Homo sapiens
cgggactttgatgtgga

SEQ ID NO: 8244 - DNA, 17 bp, Homo sapiens
gggactttgatgtggag

SEQ ID NO: 8245 - DNA, 17 bp, Homo sapiens
ggactttgatgtggaga

SEQ ID NO: 8246 - DNA, 17 bp, Homo sapiens
gactttgatgtggagaa

SEQ ID NO: 8247 - DNA, 17 bp, Homo sapiens
actttgatgtggagaag

SEQ ID NO: 8248 - DNA, 17 bp, Homo sapiens
ctttgatgtggagaagc

SEQ ID NO: 8249 - DNA, 17 bp, Homo sapiens
tttgatgtggagaagcg

SEQ ID NO: 8250 - DNA, 17 bp, Homo sapiens
ttgatgtggagaagcga

SEQ ID NO: 8251 - DNA, 17 bp, Homo sapiens
tgatgtggagaagcgac

SEQ ID NO: 8252 - DNA, 17 bp, Homo sapiens
gatgtggagaagcgact

SEQ ID NO: 8253 - DNA, 17 bp, Homo sapiens
atgtggagaagcgactt

SEQ ID NO: 8254 - DNA, 17 bp, Homo sapiens
tgtggagaagcgacttc

SEQ ID NO: 8255 - DNA, 17 bp, Homo sapiens
gtggagaagcgacttcg

SEQ ID NO: 8256 - DNA, 17 bp, Homo sapiens
tggagaagcgacttcgg

SEQ ID NO: 8257 - DNA, 17 bp, Homo sapiens
ggagaagcgacttcgga

SEQ ID NO: 8258 - DNA, 17 bp, Homo sapiens
gagaagcgacttcggag

SEQ ID NO: 8259 - DNA, 17 bp, Homo sapiens
agaagcgacttcggaga

SEQ ID NO: 8260 - DNA, 17 bp, Homo sapiens
gaagcgacttcggagag

SEQ ID NO: 8261 - DNA, 17 bp, Homo sapiens
aagcgacttcggagaga

SEQ ID NO: 8262 - DNA, 17 bp, Homo sapiens
agcgacttcggagagac

SEQ ID NO: 8263 - DNA, 17 bp, Homo sapiens
gcgacttcggagagacc

SEQ ID NO: 8264 - DNA, 17 bp, Homo sapiens
cgacttcggagagacct

SEQ ID NO: 8265 - DNA, 17 bp, Homo sapiens
gacttcggagagacctc

SEQ ID NO: 8266 - DNA, 17 bp, Homo sapiens
acttcggagagacctca

SEQ ID NO: 8267 - DNA, 17 bp, Homo sapiens
cttcggagagacctcag

SEQ ID NO: 8268 - DNA, 17 bp, Homo sapiens
ttcggagagacctcagg

SEQ ID NO: 8269 - DNA, 17 bp, Homo sapiens
tcggagagacctcagga

SEQ ID NO: 8270 - DNA, 17 bp, Homo sapiens
cggagagacctcaggag

SEQ ID NO: 8271 - DNA, 17 bp, Homo sapiens
ggagagacctcaggagg

SEQ ID NO: 8272 - DNA, 17 bp, Homo sapiens
gagagacctcaggagga

SEQ ID NO: 8273 - DNA, 17 bp, Homo sapiens
agagacctcaggaggac

SEQ ID NO: 8274 - DNA, 17 bp, Homo sapiens
gagacctcaggaggaca

SEQ ID NO: 8275 - DNA, 17 bp, Homo sapiens
agacctcaggaggacac

SEQ ID NO: 8276 - DNA, 17 bp, Homo sapiens
gacctcaggaggacaca

SEQ ID NO: 8277 - DNA, 17 bp, Homo sapiens
acctcaggaggacacat

SEQ ID NO: 8278 - DNA, 17 bp, Homo sapiens
cctcaggaggacacatg

SEQ ID NO: 8279 - DNA, 17 bp, Homo sapiens
ctcaggaggacacatgc

SEQ ID NO: 8280 - DNA, 17 bp, Homo sapiens
tcaggaggacacatgca

SEQ ID NO: 8281 - DNA, 17 bp, Homo sapiens
caggaggacacatgcac

SEQ ID NO: 8282 - DNA, 17 bp, Homo sapiens
aggaggacacatgcact

SEQ ID NO: 8283 - DNA, 17 bp, Homo sapiens
ggaggacacatgcactg

SEQ ID NO: 8284 - DNA, 17 bp, Homo sapiens
gaggacacatgcactgt

SEQ ID NO: 8285 - DNA, 17 bp, Homo sapiens
aggacacatgcactgtt

SEQ ID NO: 8286 - DNA, 17 bp, Homo sapiens
ggacacatgcactgttg

SEQ ID NO: 8287 - DNA, 17 bp, Homo sapiens
gacacatgcactgttgt

SEQ ID NO: 8288 - DNA, 17 bp, Homo sapiens
acacatgcactgttgtc

SEQ ID NO: 8289 - DNA, 17 bp, Homo sapiens
cacatgcactgttgtca

SEQ ID NO: 8290 - DNA, 17 bp, Homo sapiens
acatgcactgttgtcag

SEQ ID NO: 8291 - DNA, 17 bp, Homo sapiens
catgcactgttgtcaga

SEQ ID NO: 8292 - DNA, 17 bp, Homo sapiens
atgcactgttgtcagac

SEQ ID NO: 8293 - DNA, 17 bp, Homo sapiens
tgcactgttgtcagacg

SEQ ID NO: 8294 - DNA, 17 bp, Homo sapiens
gcactgttgtcagacgt

SEQ ID NO: 8295 - DNA, 17 bp, Homo sapiens
cactgttgtcagacgtg

SEQ ID NO: 8296 - DNA, 17 bp, Homo sapiens
actgttgtcagacgtgc

SEQ ID NO: 8297 - DNA, 17 bp, Homo sapiens
ctgttgtcagacgtgca

SEQ ID NO: 8298 - DNA, 17 bp, Homo sapiens
tgttgtcagacgtgcag

SEQ ID NO: 8299 - DNA, 17 bp, Homo sapiens
gttgtcagacgtgcagc

SEQ ID NO: 8300 - DNA, 17 bp, Homo sapiens
ttgtcagacgtgcagct

SEQ ID NO: 8301 - DNA, 17 bp, Homo sapiens
tgtcagacgtgcagctc

SEQ ID NO: 8302 - DNA, 17 bp, Homo sapiens
gtcagacgtgcagctcc

SEQ ID NO: 8303 - DNA, 17 bp, Homo sapiens
tcagacgtgcagctcct

SEQ ID NO: 8304 - DNA, 17 bp, Homo sapiens
cagacgtgcagctcctt

SEQ ID NO: 8305 - DNA, 17 bp, Homo sapiens
agacgtgcagctccttc

SEQ ID NO: 8306 - DNA, 17 bp, Homo sapiens
gacgtgcagctccttct

SEQ ID NO: 8307 - DNA, 17 bp, Homo sapiens
acgtgcagctccttctg

SEQ ID NO: 8308 - DNA, 17 bp, Homo sapiens
cgtgcagctccttctgg

SEQ ID NO: 8309 - DNA, 17 bp, Homo sapiens
gtgcagctccttctggg

SEQ ID NO: 8310 - DNA, 17 bp, Homo sapiens
tgcagctccttctgggc

SEQ ID NO: 8311 - DNA, 17 bp, Homo sapiens
gcagctccttctgggca

SEQ ID NO: 8312 - DNA, 17 bp, Homo sapiens
cagctccttctgggcac

SEQ ID NO: 8313 - DNA, 17 bp, Homo sapiens
agctccttctgggcacc

SEQ ID NO: 8314 - DNA, 17 bp, Homo sapiens
gctccttctgggcacca

SEQ ID NO: 8315 - DNA, 17 bp, Homo sapiens
ctccttctgggcaccat

SEQ ID NO: 8316 - DNA, 17 bp, Homo sapiens
tccttctgggcaccatg

SEQ ID NO: 8317 - DNA, 17 bp, Homo sapiens
ccttctgggcaccatgg

SEQ ID NO: 8318 - DNA, 17 bp, Homo sapiens
cttctgggcaccatgga

SEQ ID NO: 8319 - DNA, 17 bp, Homo sapiens
ttctgggcaccatggag

SEQ ID NO: 8320 - DNA, 17 bp, Homo sapiens
tctgggcaccatggagg

SEQ ID NO: 8321 - DNA, 17 bp, Homo sapiens
ctgggcaccatggagga

SEQ ID NO: 8322 - DNA, 17 bp, Homo sapiens
tgggcaccatggaggat

SEQ ID NO: 8323 - DNA, 17 bp, Homo sapiens
gggcaccatggaggatg

SEQ ID NO: 8324 - DNA, 17 bp, Homo sapiens
ggcaccatggaggatgg

SEQ ID NO: 8325 - DNA, 17 bp, Homo sapiens
gcaccatggaggatggc

SEQ ID NO: 8326 - DNA, 17 bp, Homo sapiens
caccatggaggatggca

SEQ ID NO: 8327 - DNA, 17 bp, Homo sapiens
accatggaggatggcaa

SEQ ID NO: 8328 - DNA, 17 bp, Homo sapiens
ccatggaggatggcaag

SEQ ID NO: 8329 - DNA, 17 bp, Homo sapiens
catggaggatggcaaga

SEQ ID NO: 8330 - DNA, 17 bp, Homo sapiens
atggaggatggcaagac

SEQ ID NO: 8331 - DNA, 17 bp, Homo sapiens
tggaggatggcaagaca

SEQ ID NO: 8332 - DNA, 17 bp, Homo sapiens
ggaggatggcaagacat

SEQ ID NO: 8333 - DNA, 17 bp, Homo sapiens
gaggatggcaagacatc

SEQ ID NO: 8334 - DNA, 17 bp, Homo sapiens
aggatggcaagacatca

SEQ ID NO: 8335 - DNA, 17 bp, Homo sapiens
ggatggcaagacatcag

SEQ ID NO: 8336 - DNA, 17 bp, Homo sapiens
gatggcaagacatcagt

SEQ ID NO: 8337 - DNA, 17 bp, Homo sapiens
atggcaagacatcagtc

SEQ ID NO: 8338 - DNA, 17 bp, Homo sapiens
tggcaagacatcagtca

SEQ ID NO: 8339 - DNA, 17 bp, Homo sapiens
ggcaagacatcagtcag

SEQ ID NO: 8340 - DNA, 17 bp, Homo sapiens
gcaagacatcagtcagc

SEQ ID NO: 8341 - DNA, 17 bp, Homo sapiens
caagacatcagtcagca

SEQ ID NO: 8342 - DNA, 17 bp, Homo sapiens
aagacatcagtcagcaa

SEQ ID NO: 8343 - DNA, 17 bp, Homo sapiens
agacatcagtcagcaag

SEQ ID NO: 8344 - DNA, 17 bp, Homo sapiens
gacatcagtcagcaagg

SEQ ID NO: 8345 - DNA, 17 bp, Homo sapiens
acatcagtcagcaagga

SEQ ID NO: 8346 - DNA, 17 bp, Homo sapiens
catcagtcagcaaggag

SEQ ID NO: 8347 - DNA, 17 bp, Homo sapiens
atcagtcagcaaggagg

SEQ ID NO: 8348 - DNA, 17 bp, Homo sapiens
tcagtcagcaaggagga

SEQ ID NO: 8349 - DNA, 17 bp, Homo sapiens
cagtcagcaaggaggag

SEQ ID NO: 8350 - DNA, 17 bp, Homo sapiens
agtcagcaaggaggagc

SEQ ID NO: 8351 - DNA, 17 bp, Homo sapiens
gtcagcaaggaggagct

SEQ ID NO: 8352 - DNA, 17 bp, Homo sapiens
tcagcaaggaggagctg

SEQ ID NO: 8353 - DNA, 17 bp, Homo sapiens
cagcaaggaggagctgg

SEQ ID NO: 8354 - DNA, 17 bp, Homo sapiens
agcaaggaggagctgga

SEQ ID NO: 8355 - DNA, 17 bp, Homo sapiens
gcaaggaggagctggag

SEQ ID NO: 8356 - DNA, 17 bp, Homo sapiens
caaggaggagctggaga

SEQ ID NO: 8357 - DNA, 17 bp, Homo sapiens
aaggaggagctggagaa

SEQ ID NO: 8358 - DNA, 17 bp, Homo sapiens
aggaggagctggagaaa

SEQ ID NO: 8359 - DNA, 17 bp, Homo sapiens
ggaggagctggagaaag

SEQ ID NO: 8360 - DNA, 17 bp, Homo sapiens
gaggagctggagaaagt

SEQ ID NO: 8361 - DNA, 17 bp, Homo sapiens
aggagctggagaaagtg

SEQ ID NO: 8362 - DNA, 17 bp, Homo sapiens
ggagctggagaaagtgc

SEQ ID NO: 8363 - DNA, 17 bp, Homo sapiens
gagctggagaaagtgca

SEQ ID NO: 8364 - DNA, 17 bp, Homo sapiens
agctggagaaagtgcac

SEQ ID NO: 8365 - DNA, 17 bp, Homo sapiens
gctggagaaagtgcaca

SEQ ID NO: 8366 - DNA, 17 bp, Homo sapiens
ctggagaaagtgcacag

SEQ ID NO: 8367 - DNA, 17 bp, Homo sapiens
tggagaaagtgcacagc

SEQ ID NO: 8368 - DNA, 17 bp, Homo sapiens
ggagaaagtgcacagcc

SEQ ID NO: 8369 - DNA, 17 bp, Homo sapiens
gagaaagtgcacagcca

SEQ ID NO: 8370 - DNA, 17 bp, Homo sapiens
agaaagtgcacagccag

SEQ ID NO: 8371 - DNA, 17 bp, Homo sapiens
gaaagtgcacagccagc

SEQ ID NO: 8372 - DNA, 17 bp, Homo sapiens
aaagtgcacagccagct

SEQ ID NO: 8373 - DNA, 17 bp, Homo sapiens
aagtgcacagccagctg

SEQ ID NO: 8374 - DNA, 17 bp, Homo sapiens
agtgcacagccagctgg

SEQ ID NO: 8375 - DNA, 17 bp, Homo sapiens
gtgcacagccagctgga

SEQ ID NO: 8376 - DNA, 17 bp, Homo sapiens
tgcacagccagctggag

SEQ ID NO: 8377 - DNA, 17 bp, Homo sapiens
gcacagccagctggagc

SEQ ID NO: 8378 - DNA, 17 bp, Homo sapiens
cacagccagctggagca

SEQ ID NO: 8379 - DNA, 17 bp, Homo sapiens
acagccagctggagcag

SEQ ID NO: 8380 - DNA, 17 bp, Homo sapiens
cagccagctggagcaga

SEQ ID NO: 8381 - DNA, 17 bp, Homo sapiens
agccagctggagcagag

SEQ ID NO: 8382 - DNA, 17 bp, Homo sapiens
gccagctggagcagagt

SEQ ID NO: 8383 - DNA, 17 bp, Homo sapiens
ccagctggagcagagtg

SEQ ID NO: 8384 - DNA, 17 bp, Homo sapiens
cagctggagcagagtga

SEQ ID NO: 8385 - DNA, 17 bp, Homo sapiens
agctggagcagagtgaa

SEQ ID NO: 8386 - DNA, 17 bp, Homo sapiens
gctggagcagagtgaag

SEQ ID NO: 8387 - DNA, 17 bp, Homo sapiens
ctggagcagagtgaagc

SEQ ID NO: 8388 - DNA, 17 bp, Homo sapiens
tggagcagagtgaagcc

SEQ ID NO: 8389 - DNA, 17 bp, Homo sapiens
ggagcagagtgaagcca

SEQ ID NO: 8390 - DNA, 17 bp, Homo sapiens
gagcagagtgaagccaa

SEQ ID NO: 8391 - DNA, 17 bp, Homo sapiens
agcagagtgaagccaag

SEQ ID NO: 8392 - DNA, 17 bp, Homo sapiens
gcagagtgaagccaagt

SEQ ID NO: 8393 - DNA, 17 bp, Homo sapiens
cagagtgaagccaagtg

SEQ ID NO: 8394 - DNA, 17 bp, Homo sapiens
agagtgaagccaagtgt

SEQ ID NO: 8395 - DNA, 17 bp, Homo sapiens
gagtgaagccaagtgtg

SEQ ID NO: 8396 - DNA, 17 bp, Homo sapiens
agtgaagccaagtgtga

SEQ ID NO: 8397 - DNA, 17 bp, Homo sapiens
gtgaagccaagtgtgag

SEQ ID NO: 8398 - DNA, 17 bp, Homo sapiens
tgaagccaagtgtgagg

SEQ ID NO: 8399 - DNA, 17 bp, Homo sapiens
gaagccaagtgtgagga

SEQ ID NO: 8400 - DNA, 17 bp, Homo sapiens
aagccaagtgtgaggag

SEQ ID NO: 8401 - DNA, 17 bp, Homo sapiens
agccaagtgtgaggagg

SEQ ID NO: 8402 - DNA, 17 bp, Homo sapiens
gccaagtgtgaggaggc

SEQ ID NO: 8403 - DNA, 17 bp, Homo sapiens
ccaagtgtgaggaggcc

SEQ ID NO: 8404 - DNA, 17 bp, Homo sapiens
caagtgtgaggaggcct

SEQ ID NO: 8405 - DNA, 17 bp, Homo sapiens
aagtgtgaggaggcctt

SEQ ID NO: 8406 - DNA, 17 bp, Homo sapiens
agtgtgaggaggccttg

SEQ ID NO: 8407 - DNA, 17 bp, Homo sapiens
gtgtgaggaggccttga

SEQ ID NO: 8408 - DNA, 17 bp, Homo sapiens
tgtgaggaggccttgaa

SEQ ID NO: 8409 - DNA, 17 bp, Homo sapiens
gtgaggaggccttgaag

SEQ ID NO: 8410 - DNA, 17 bp, Homo sapiens
tgaggaggccttgaaga

SEQ ID NO: 8411 - DNA, 17 bp, Homo sapiens
gaggaggccttgaagac

SEQ ID NO: 8412 - DNA, 17 bp, Homo sapiens
aggaggccttgaagacg

SEQ ID NO: 8413 - DNA, 17 bp, Homo sapiens
ggaggccttgaagacgc

SEQ ID NO: 8414 - DNA, 17 bp, Homo sapiens
gaggccttgaagacgca

SEQ ID NO: 8415 - DNA, 17 bp, Homo sapiens
aggccttgaagacgcag

SEQ ID NO: 8416 - DNA, 17 bp, Homo sapiens
ggccttgaagacgcaga

SEQ ID NO: 8417 - DNA, 17 bp, Homo sapiens
gccttgaagacgcagaa

SEQ ID NO: 8418 - DNA, 17 bp, Homo sapiens
ccttgaagacgcagaag

SEQ ID NO: 8419 - DNA, 17 bp, Homo sapiens
cttgaagacgcagaagg

SEQ ID NO: 8420 - DNA, 17 bp, Homo sapiens
ttgaagacgcagaaggt

SEQ ID NO: 8421 - DNA, 17 bp, Homo sapiens
tgaagacgcagaaggtg

SEQ ID NO: 8422 - DNA, 17 bp, Homo sapiens
gaagacgcagaaggtgc

SEQ ID NO: 8423 - DNA, 17 bp, Homo sapiens
aagacgcagaaggtgct

SEQ ID NO: 8424 - DNA, 17 bp, Homo sapiens
agacgcagaaggtgctc

SEQ ID NO: 8425 - DNA, 17 bp, Homo sapiens
gacgcagaaggtgctca

SEQ ID NO: 8426 - DNA, 17 bp, Homo sapiens
acgcagaaggtgctcac

SEQ ID NO: 8427 - DNA, 17 bp, Homo sapiens
cgcagaaggtgctcaca

SEQ ID NO: 8428 - DNA, 17 bp, Homo sapiens
gcagaaggtgctcacag

SEQ ID NO: 8429 - DNA, 17 bp, Homo sapiens
cagaaggtgctcacagc

SEQ ID NO: 8430 - DNA, 17 bp, Homo sapiens
agaaggtgctcacagcg

SEQ ID NO: 8431 - DNA, 17 bp, Homo sapiens
gaaggtgctcacagcgg

SEQ ID NO: 8432 - DNA, 17 bp, Homo sapiens
aaggtgctcacagcgga

SEQ ID NO: 8433 - DNA, 17 bp, Homo sapiens
aggtgctcacagcggac

SEQ ID NO: 8434 - DNA, 17 bp, Homo sapiens
ggtgctcacagcggacc

SEQ ID NO: 8435 - DNA, 17 bp, Homo sapiens
gtgctcacagcggacct

SEQ ID NO: 8436 - DNA, 17 bp, Homo sapiens
tgctcacagcggacctg

SEQ ID NO: 8437 - DNA, 17 bp, Homo sapiens
gctcacagcggacctgg

SEQ ID NO: 8438 - DNA, 17 bp, Homo sapiens
ctcacagcggacctgga

SEQ ID NO: 8439 - DNA, 17 bp, Homo sapiens
tcacagcggacctggag

SEQ ID NO: 8440 - DNA, 17 bp, Homo sapiens
cacagcggacctggaga

SEQ ID NO: 8441 - DNA, 17 bp, Homo sapiens
acagcggacctggagag

SEQ ID NO: 8442 - DNA, 17 bp, Homo sapiens
cagcggacctggagagc

SEQ ID NO: 8443 - DNA, 17 bp, Homo sapiens
agcggacctggagagca

SEQ ID NO: 8444 - DNA, 17 bp, Homo sapiens
gcggacctggagagcat

SEQ ID NO: 8445 - DNA, 17 bp, Homo sapiens
cggacctggagagcatg

SEQ ID NO: 8446 - DNA, 17 bp, Homo sapiens
ggacctggagagcatgc

SEQ ID NO: 8447 - DNA, 17 bp, Homo sapiens
gacctggagagcatgca

SEQ ID NO: 8448 - DNA, 17 bp, Homo sapiens
acctggagagcatgcac

SEQ ID NO: 8449 - DNA, 17 bp, Homo sapiens
cctggagagcatgcaca

SEQ ID NO: 8450 - DNA, 17 bp, Homo sapiens
ctggagagcatgcacag

SEQ ID NO: 8451 - DNA, 17 bp, Homo sapiens
tggagagcatgcacagc

SEQ ID NO: 8452 - DNA, 17 bp, Homo sapiens
ggagagcatgcacagcg

SEQ ID NO: 8453 - DNA, 17 bp, Homo sapiens
gagagcatgcacagcga

SEQ ID NO: 8454 - DNA, 17 bp, Homo sapiens
agagcatgcacagcgag

SEQ ID NO: 8455 - DNA, 17 bp, Homo sapiens
gagcatgcacagcgagc

SEQ ID NO: 8456 - DNA, 17 bp, Homo sapiens
agcatgcacagcgagct

SEQ ID NO: 8457 - DNA, 17 bp, Homo sapiens
gcatgcacagcgagctg

SEQ ID NO: 8458 - DNA, 17 bp, Homo sapiens
catgcacagcgagctgg

SEQ ID NO: 8459 - DNA, 17 bp, Homo sapiens
atgcacagcgagctgga

SEQ ID NO: 8460 - DNA, 17 bp, Homo sapiens
tgcacagcgagctggag

SEQ ID NO: 8461 - DNA, 17 bp, Homo sapiens
gcacagcgagctggaga

SEQ ID NO: 8462 - DNA, 17 bp, Homo sapiens
cacagcgagctggagaa

SEQ ID NO: 8463 - DNA, 17 bp, Homo sapiens
acagcgagctggagaac

SEQ ID NO: 8464 - DNA, 17 bp, Homo sapiens
cagcgagctggagaaca

SEQ ID NO: 8465 - DNA, 17 bp, Homo sapiens
agcgagctggagaacat

SEQ ID NO: 8466 - DNA, 17 bp, Homo sapiens
gcgagctggagaacatg

SEQ ID NO: 8467 - DNA, 17 bp, Homo sapiens
cgagctggagaacatga

SEQ ID NO: 8468 - DNA, 17 bp, Homo sapiens
gagctggagaacatgac

SEQ ID NO: 8469 - DNA, 17 bp, Homo sapiens
agctggagaacatgacg

SEQ ID NO: 8470 - DNA, 17 bp, Homo sapiens
gctggagaacatgacgc

SEQ ID NO: 8471 - DNA, 17 bp, Homo sapiens
ctggagaacatgacgcg

SEQ ID NO: 8472 - DNA, 17 bp, Homo sapiens
tggagaacatgacgcgg

SEQ ID NO: 8473 - DNA, 17 bp, Homo sapiens
ggagaacatgacgcgga

SEQ ID NO: 8474 - DNA, 17 bp, Homo sapiens
gagaacatgacgcggaa

SEQ ID NO: 8475 - DNA, 17 bp, Homo sapiens
agaacatgacgcggaac

SEQ ID NO: 8476 - DNA, 17 bp, Homo sapiens
gaacatgacgcggaaca

SEQ ID NO: 8477 - DNA, 17 bp, Homo sapiens
aacatgacgcggaacaa

SEQ ID NO: 8478 - DNA, 17 bp, Homo sapiens
acatgacgcggaacaag

SEQ ID NO: 8479 - DNA, 17 bp, Homo sapiens
catgacgcggaacaaga

SEQ ID NO: 8480 - DNA, 17 bp, Homo sapiens
atgacgcggaacaagag

SEQ ID NO: 8481 - DNA, 17 bp, Homo sapiens
tgacgcggaacaagagc

SEQ ID NO: 8482 - DNA, 17 bp, Homo sapiens
gacgcggaacaagagcc

SEQ ID NO: 8483 - DNA, 17 bp, Homo sapiens
acgcggaacaagagcct

SEQ ID NO: 8484 - DNA, 17 bp, Homo sapiens
cgcggaacaagagcctg

SEQ ID NO: 8485 - DNA, 17 bp, Homo sapiens
gcggaacaagagcctgg

SEQ ID NO: 8486 - DNA, 17 bp, Homo sapiens
cggaacaagagcctggt

SEQ ID NO: 8487 - DNA, 17 bp, Homo sapiens
ggaacaagagcctggtg

SEQ ID NO: 8488 - DNA, 17 bp, Homo sapiens
gaacaagagcctggtgg

SEQ ID NO: 8489 - DNA, 17 bp, Homo sapiens
aacaagagcctggtgga

SEQ ID NO: 8490 - DNA, 17 bp, Homo sapiens
acaagagcctggtggat

SEQ ID NO: 8491 - DNA, 17 bp, Homo sapiens
caagagcctggtggatg

SEQ ID NO: 8492 - DNA, 17 bp, Homo sapiens
aagagcctggtggatga

SEQ ID NO: 8493 - DNA, 17 bp, Homo sapiens
agagcctggtggatgag

SEQ ID NO: 8494 - DNA, 17 bp, Homo sapiens
gagcctggtggatgagc

SEQ ID NO: 8495 - DNA, 17 bp, Homo sapiens
agcctggtggatgagca

SEQ ID NO: 8496 - DNA, 17 bp, Homo sapiens
gcctggtggatgagcag

SEQ ID NO: 8497 - DNA, 17 bp, Homo sapiens
cctggtggatgagcagc

SEQ ID NO: 8498 - DNA, 17 bp, Homo sapiens
ctggtggatgagcagct

SEQ ID NO: 8499 - DNA, 17 bp, Homo sapiens
tggtggatgagcagctg

SEQ ID NO: 8500 - DNA, 17 bp, Homo sapiens
ggtggatgagcagctgt

SEQ ID NO: 8501 - DNA, 17 bp, Homo sapiens
gtggatgagcagctgta

SEQ ID NO: 8502 - DNA, 17 bp, Homo sapiens
tggatgagcagctgtac

SEQ ID NO: 8503 - DNA, 17 bp, Homo sapiens
ggatgagcagctgtaca

SEQ ID NO: 8504 - DNA, 17 bp, Homo sapiens
gatgagcagctgtacag

SEQ ID NO: 8505 - DNA, 17 bp, Homo sapiens
atgagcagctgtacagg

SEQ ID NO: 8506 - DNA, 17 bp, Homo sapiens
tgagcagctgtacaggc

SEQ ID NO: 8507 - DNA, 17 bp, Homo sapiens
gagcagctgtacaggct

SEQ ID NO: 8508 - DNA, 17 bp, Homo sapiens
agcagctgtacaggctg

SEQ ID NO: 8509 - DNA, 17 bp, Homo sapiens
gcagctgtacaggctgc

SEQ ID NO: 8510 - DNA, 17 bp, Homo sapiens
cagctgtacaggctgca

SEQ ID NO: 8511 - DNA, 17 bp, Homo sapiens
agctgtacaggctgcag

SEQ ID NO: 8512 - DNA, 17 bp, Homo sapiens
gctgtacaggctgcagt

SEQ ID NO: 8513 - DNA, 17 bp, Homo sapiens
ctgtacaggctgcagtt

SEQ ID NO: 8514 - DNA, 17 bp, Homo sapiens
tgtacaggctgcagttt

SEQ ID NO: 8515 - DNA, 17 bp, Homo sapiens
gtacaggctgcagtttg

SEQ ID NO: 8516 - DNA, 17 bp, Homo sapiens
tacaggctgcagtttga

SEQ ID NO: 8517 - DNA, 17 bp, Homo sapiens
acaggctgcagtttgag

SEQ ID NO: 8518 - DNA, 17 bp, Homo sapiens
caggctgcagtttgaga

SEQ ID NO: 8519 - DNA, 17 bp, Homo sapiens
aggctgcagtttgagaa

SEQ ID NO: 8520 - DNA, 17 bp, Homo sapiens
ggctgcagtttgagaag

SEQ ID NO: 8521 - DNA, 17 bp, Homo sapiens
gctgcagtttgagaagg

SEQ ID NO: 8522 - DNA, 17 bp, Homo sapiens
ctgcagtttgagaaggc

SEQ ID NO: 8523 - DNA, 17 bp, Homo sapiens
tgcagtttgagaaggcg

SEQ ID NO: 8524 - DNA, 17 bp, Homo sapiens
gcagtttgagaaggcgg

SEQ ID NO: 8525 - DNA, 17 bp, Homo sapiens
cagtttgagaaggcgga

SEQ ID NO: 8526 - DNA, 17 bp, Homo sapiens
agtttgagaaggcggac

SEQ ID NO: 8527 - DNA, 17 bp, Homo sapiens
gtttgagaaggcggacc

SEQ ID NO: 8528 - DNA, 17 bp, Homo sapiens
tttgagaaggcggacct

SEQ ID NO: 8529 - DNA, 17 bp, Homo sapiens
ttgagaaggcggacctc

SEQ ID NO: 8530 - DNA, 17 bp, Homo sapiens
tgagaaggcggacctcc

SEQ ID NO: 8531 - DNA, 17 bp, Homo sapiens
gagaaggcggacctcct

SEQ ID NO: 8532 - DNA, 17 bp, Homo sapiens
agaaggcggacctcctg

SEQ ID NO: 8533 - DNA, 17 bp, Homo sapiens
gaaggcggacctcctga

SEQ ID NO: 8534 - DNA, 17 bp, Homo sapiens
aaggcggacctcctgaa

SEQ ID NO: 8535 - DNA, 17 bp, Homo sapiens
aggcggacctcctgaag

SEQ ID NO: 8536 - DNA, 17 bp, Homo sapiens
ggcggacctcctgaagc

SEQ ID NO: 8537 - DNA, 17 bp, Homo sapiens
gcggacctcctgaagcg

SEQ ID NO: 8538 - DNA, 17 bp, Homo sapiens
cggacctcctgaagcgc

SEQ ID NO: 8539 - DNA, 17 bp, Homo sapiens
ggacctcctgaagcgca

SEQ ID NO: 8540 - DNA, 17 bp, Homo sapiens
gacctcctgaagcgcat

SEQ ID NO: 8541 - DNA, 17 bp, Homo sapiens
acctcctgaagcgcatc

SEQ ID NO: 8542 - DNA, 17 bp, Homo sapiens
cctcctgaagcgcatcg

SEQ ID NO: 8543 - DNA, 17 bp, Homo sapiens
ctcctgaagcgcatcga

SEQ ID NO: 8544 - DNA, 17 bp, Homo sapiens
tcctgaagcgcatcgat

SEQ ID NO: 8545 - DNA, 17 bp, Homo sapiens
cctgaagcgcatcgatg

SEQ ID NO: 8546 - DNA, 17 bp, Homo sapiens
ctgaagcgcatcgatga

SEQ ID NO: 8547 - DNA, 17 bp, Homo sapiens
tgaagcgcatcgatgag

SEQ ID NO: 8548 - DNA, 17 bp, Homo sapiens
gaagcgcatcgatgagg

SEQ ID NO: 8549 - DNA, 17 bp, Homo sapiens
aagcgcatcgatgagga

SEQ ID NO: 8550 - DNA, 17 bp, Homo sapiens
agcgcatcgatgaggac

SEQ ID NO: 8551 - DNA, 17 bp, Homo sapiens
gcgcatcgatgaggacc

SEQ ID NO: 8552 - DNA, 17 bp, Homo sapiens
cgcatcgatgaggacca

SEQ ID NO: 8553 - DNA, 17 bp, Homo sapiens
gcatcgatgaggaccag

SEQ ID NO: 8554 - DNA, 17 bp, Homo sapiens
catcgatgaggaccagg

SEQ ID NO: 8555 - DNA, 17 bp, Homo sapiens
atcgatgaggaccagga

SEQ ID NO: 8556 - DNA, 17 bp, Homo sapiens
tcgatgaggaccaggat

SEQ ID NO: 8557 - DNA, 17 bp, Homo sapiens
cgatgaggaccaggatg

SEQ ID NO: 8558 - DNA, 17 bp, Homo sapiens
gatgaggaccaggatga

SEQ ID NO: 8559 - DNA, 17 bp, Homo sapiens
atgaggaccaggatgac

SEQ ID NO: 8560 - DNA, 17 bp, Homo sapiens
tgaggaccaggatgacc

SEQ ID NO: 8561 - DNA, 17 bp, Homo sapiens
gaggaccaggatgacct

SEQ ID NO: 8562 - DNA, 17 bp, Homo sapiens
aggaccaggatgacctg

SEQ ID NO: 8563 - DNA, 17 bp, Homo sapiens
ggaccaggatgacctga

SEQ ID NO: 8564 - DNA, 17 bp, Homo sapiens
gaccaggatgacctgaa

SEQ ID NO: 8565 - DNA, 17 bp, Homo sapiens
accaggatgacctgaat

SEQ ID NO: 8566 - DNA, 17 bp, Homo sapiens
ccaggatgacctgaatg

SEQ ID NO: 8567 - DNA, 17 bp, Homo sapiens
caggatgacctgaatga

SEQ ID NO: 8568 - DNA, 17 bp, Homo sapiens
aggatgacctgaatgag

SEQ ID NO: 8569 - DNA, 17 bp, Homo sapiens
ggatgacctgaatgagc

SEQ ID NO: 8570 - DNA, 17 bp, Homo sapiens
gatgacctgaatgagct

SEQ ID NO: 8571 - DNA, 17 bp, Homo sapiens
atgacctgaatgagctg

SEQ ID NO: 8572 - DNA, 17 bp, Homo sapiens
tgacctgaatgagctga

SEQ ID NO: 8573 - DNA, 17 bp, Homo sapiens
gacctgaatgagctgat

SEQ ID NO: 8574 - DNA, 17 bp, Homo sapiens
acctgaatgagctgatg

SEQ ID NO: 8575 - DNA, 17 bp, Homo sapiens
cctgaatgagctgatgc

SEQ ID NO: 8576 - DNA, 17 bp, Homo sapiens
ctgaatgagctgatgca

SEQ ID NO: 8577 - DNA, 17 bp, Homo sapiens
tgaatgagctgatgcag

SEQ ID NO: 8578 - DNA, 17 bp, Homo sapiens
gaatgagctgatgcaga

SEQ ID NO: 8579 - DNA, 17 bp, Homo sapiens
aatgagctgatgcagaa

SEQ ID NO: 8580 - DNA, 17 bp, Homo sapiens
atgagctgatgcagaag

SEQ ID NO: 8581 - DNA, 17 bp, Homo sapiens
tgagctgatgcagaagc

SEQ ID NO: 8582 - DNA, 17 bp, Homo sapiens
gagctgatgcagaagca

SEQ ID NO: 8583 - DNA, 17 bp, Homo sapiens
agctgatgcagaagcac

SEQ ID NO: 8584 - DNA, 17 bp, Homo sapiens
gctgatgcagaagcaca

SEQ ID NO: 8585 - DNA, 17 bp, Homo sapiens
ctgatgcagaagcacaa

SEQ ID NO: 8586 - DNA, 17 bp, Homo sapiens
tgatgcagaagcacaag

SEQ ID NO: 8587 - DNA, 17 bp, Homo sapiens
gatgcagaagcacaagg

SEQ ID NO: 8588 - DNA, 17 bp, Homo sapiens
atgcagaagcacaagga

SEQ ID NO: 8589 - DNA, 17 bp, Homo sapiens
tgcagaagcacaaggac

SEQ ID NO: 8590 - DNA, 17 bp, Homo sapiens
gcagaagcacaaggacc

SEQ ID NO: 8591 - DNA, 17 bp, Homo sapiens
cagaagcacaaggacct

SEQ ID NO: 8592 - DNA, 17 bp, Homo sapiens
agaagcacaaggacctc

SEQ ID NO: 8593 - DNA, 17 bp, Homo sapiens
gaagcacaaggacctca

SEQ ID NO: 8594 - DNA, 17 bp, Homo sapiens
aagcacaaggacctcat

SEQ ID NO: 8595 - DNA, 17 bp, Homo sapiens
agcacaaggacctcatt

SEQ ID NO: 8596 - DNA, 17 bp, Homo sapiens
gcacaaggacctcattg

SEQ ID NO: 8597 - DNA, 17 bp, Homo sapiens
cacaaggacctcattgc

SEQ ID NO: 8598 - DNA, 17 bp, Homo sapiens
acaaggacctcattgct

SEQ ID NO: 8599 - DNA, 17 bp, Homo sapiens
caaggacctcattgctc

SEQ ID NO: 8600 - DNA, 17 bp, Homo sapiens
aaggacctcattgctca

SEQ ID NO: 8601 - DNA, 17 bp, Homo sapiens
aggacctcattgctcag

SEQ ID NO: 8602 - DNA, 17 bp, Homo sapiens
ggacctcattgctcagt

SEQ ID NO: 8603 - DNA, 17 bp, Homo sapiens
gacctcattgctcagtc

SEQ ID NO: 8604 - DNA, 17 bp, Homo sapiens
acctcattgctcagtct

SEQ ID NO: 8605 - DNA, 17 bp, Homo sapiens
cctcattgctcagtctg

SEQ ID NO: 8606 - DNA, 17 bp, Homo sapiens
ctcattgctcagtctgc

SEQ ID NO: 8607 - DNA, 17 bp, Homo sapiens
tcattgctcagtctgct

SEQ ID NO: 8608 - DNA, 17 bp, Homo sapiens
cattgctcagtctgctg

SEQ ID NO: 8609 - DNA, 17 bp, Homo sapiens
attgctcagtctgctgc

SEQ ID NO: 8610 - DNA, 17 bp, Homo sapiens
ttgctcagtctgctgct

SEQ ID NO: 8611 - DNA, 17 bp, Homo sapiens
tgctcagtctgctgctg

SEQ ID NO: 8612 - DNA, 17 bp, Homo sapiens
gctcagtctgctgctga

SEQ ID NO: 8613 - DNA, 17 bp, Homo sapiens
ctcagtctgctgctgac

SEQ ID NO: 8614 - DNA, 17 bp, Homo sapiens
tcagtctgctgctgaca

SEQ ID NO: 8615 - DNA, 17 bp, Homo sapiens
cagtctgctgctgacat

SEQ ID NO: 8616 - DNA, 17 bp, Homo sapiens
agtctgctgctgacatt

SEQ ID NO: 8617 - DNA, 17 bp, Homo sapiens
gtctgctgctgacattg

SEQ ID NO: 8618 - DNA, 17 bp, Homo sapiens
tctgctgctgacattgg

SEQ ID NO: 8619 - DNA, 17 bp, Homo sapiens
ctgctgctgacattggg

SEQ ID NO: 8620 - DNA, 17 bp, Homo sapiens
tgctgctgacattgggc

SEQ ID NO: 8621 - DNA, 17 bp, Homo sapiens
gctgctgacattgggca

SEQ ID NO: 8622 - DNA, 17 bp, Homo sapiens
ctgctgacattgggcag

SEQ ID NO: 8623 - DNA, 17 bp, Homo sapiens
tgctgacattgggcaga

SEQ ID NO: 8624 - DNA, 17 bp, Homo sapiens
gctgacattgggcagat

SEQ ID NO: 8625 - DNA, 17 bp, Homo sapiens
ctgacattgggcagatc

SEQ ID NO: 8626 - DNA, 17 bp, Homo sapiens
tgacattgggcagatcc

SEQ ID NO: 8627 - DNA, 17 bp, Homo sapiens
gacattgggcagatcca

SEQ ID NO: 8628 - DNA, 17 bp, Homo sapiens
acattgggcagatccaa

SEQ ID NO: 8629 - DNA, 17 bp, Homo sapiens
cattgggcagatccaag

SEQ ID NO: 8630 - DNA, 17 bp, Homo sapiens
attgggcagatccaaga

SEQ ID NO: 8631 - DNA, 17 bp, Homo sapiens
ttgggcagatccaagaa

SEQ ID NO: 8632 - DNA, 17 bp, Homo sapiens
tgggcagatccaagaac

SEQ ID NO: 8633 - DNA, 17 bp, Homo sapiens
gggcagatccaagaact

SEQ ID NO: 8634 - DNA, 17 bp, Homo sapiens
ggcagatccaagaactg

SEQ ID NO: 8635 - DNA, 17 bp, Homo sapiens
gcagatccaagaactgc

SEQ ID NO: 8636 - DNA, 17 bp, Homo sapiens
cagatccaagaactgca

SEQ ID NO: 8637 - DNA, 17 bp, Homo sapiens
agatccaagaactgcag

SEQ ID NO: 8638 - DNA, 17 bp, Homo sapiens
gatccaagaactgcagc

SEQ ID NO: 8639 - DNA, 17 bp, Homo sapiens
atccaagaactgcagct

SEQ ID NO: 8640 - DNA, 17 bp, Homo sapiens
tccaagaactgcagctg

SEQ ID NO: 8641 - DNA, 17 bp, Homo sapiens
ccaagaactgcagctgc

SEQ ID NO: 8642 - DNA, 17 bp, Homo sapiens
caagaactgcagctgca

SEQ ID NO: 8643 - DNA, 17 bp, Homo sapiens
aagaactgcagctgcag

SEQ ID NO: 8644 - DNA, 17 bp, Homo sapiens
agaactgcagctgcagc

SEQ ID NO: 8645 - DNA, 17 bp, Homo sapiens
gaactgcagctgcagct

SEQ ID NO: 8646 - DNA, 17 bp, Homo sapiens
aactgcagctgcagctg

SEQ ID NO: 8647 - DNA, 17 bp, Homo sapiens
actgcagctgcagctgg

SEQ ID NO: 8648 - DNA, 17 bp, Homo sapiens
ctgcagctgcagctgga

SEQ ID NO: 8649 - DNA, 17 bp, Homo sapiens
tgcagctgcagctggag

SEQ ID NO: 8650 - DNA, 17 bp, Homo sapiens
gcagctgcagctggagg

SEQ ID NO: 8651 - DNA, 17 bp, Homo sapiens
cagctgcagctggagga

SEQ ID NO: 8652 - DNA, 17 bp, Homo sapiens
agctgcagctggaggaa

SEQ ID NO: 8653 - DNA, 17 bp, Homo sapiens
gctgcagctggaggaag

SEQ ID NO: 8654 - DNA, 17 bp, Homo sapiens
ctgcagctggaggaagc

SEQ ID NO: 8655 - DNA, 17 bp, Homo sapiens
tgcagctggaggaagcc

SEQ ID NO: 8656 - DNA, 17 bp, Homo sapiens
gcagctggaggaagcca

SEQ ID NO: 8657 - DNA, 17 bp, Homo sapiens
cagctggaggaagccaa

SEQ ID NO: 8658 - DNA, 17 bp, Homo sapiens
agctggaggaagccaag

SEQ ID NO: 8659 - DNA, 17 bp, Homo sapiens
gctggaggaagccaaga

SEQ ID NO: 8660 - DNA, 17 bp, Homo sapiens
ctggaggaagccaagaa

SEQ ID NO: 8661 - DNA, 17 bp, Homo sapiens
tggaggaagccaagaag

SEQ ID NO: 8662 - DNA, 17 bp, Homo sapiens
ggaggaagccaagaagg

SEQ ID NO: 8663 - DNA, 17 bp, Homo sapiens
gaggaagccaagaagga

SEQ ID NO: 8664 - DNA, 17 bp, Homo sapiens
aggaagccaagaaggag

SEQ ID NO: 8665 - DNA, 17 bp, Homo sapiens
ggaagccaagaaggaga

SEQ ID NO: 8666 - DNA, 17 bp, Homo sapiens
gaagccaagaaggagaa

SEQ ID NO: 8667 - DNA, 17 bp, Homo sapiens
aagccaagaaggagaag

SEQ ID NO: 8668 - DNA, 17 bp, Homo sapiens
agccaagaaggagaagc

SEQ ID NO: 8669 - DNA, 17 bp, Homo sapiens
gccaagaaggagaagca

SEQ ID NO: 8670 - DNA, 17 bp, Homo sapiens
ccaagaaggagaagcac

SEQ ID NO: 8671 - DNA, 17 bp, Homo sapiens
caagaaggagaagcaca

SEQ ID NO: 8672 - DNA, 17 bp, Homo sapiens
aagaaggagaagcacaa

SEQ ID NO: 8673 - DNA, 17 bp, Homo sapiens
agaaggagaagcacaag

SEQ ID NO: 8674 - DNA, 17 bp, Homo sapiens
gaaggagaagcacaagc

SEQ ID NO: 8675 - DNA, 17 bp, Homo sapiens
aaggagaagcacaagct

SEQ ID NO: 8676 - DNA, 17 bp, Homo sapiens
aggagaagcacaagcta

SEQ ID NO: 8677 - DNA, 17 bp, Homo sapiens
ggagaagcacaagctac

SEQ ID NO: 8678 - DNA, 17 bp, Homo sapiens
gagaagcacaagctaca

SEQ ID NO: 8679 - DNA, 17 bp, Homo sapiens
agaagcacaagctacaa

SEQ ID NO: 8680 - DNA, 17 bp, Homo sapiens
gaagcacaagctacaag

SEQ ID NO: 8681 - DNA, 17 bp, Homo sapiens
aagcacaagctacaaga

SEQ ID NO: 8682 - DNA, 17 bp, Homo sapiens
agcacaagctacaagaa

SEQ ID NO: 8683 - DNA, 17 bp, Homo sapiens
gcacaagctacaagaac

SEQ ID NO: 8684 - DNA, 17 bp, Homo sapiens
cacaagctacaagaaca

SEQ ID NO: 8685 - DNA, 17 bp, Homo sapiens
acaagctacaagaacaa

SEQ ID NO: 8686 - DNA, 17 bp, Homo sapiens
caagctacaagaacaac

SEQ ID NO: 8687 - DNA, 17 bp, Homo sapiens
aagctacaagaacaact

SEQ ID NO: 8688 - DNA, 17 bp, Homo sapiens
agctacaagaacaactg

SEQ ID NO: 8689 - DNA, 17 bp, Homo sapiens
gctacaagaacaactgc

SEQ ID NO: 8690 - DNA, 17 bp, Homo sapiens
ctacaagaacaactgca

SEQ ID NO: 8691 - DNA, 17 bp, Homo sapiens
tacaagaacaactgcag

SEQ ID NO: 8692 - DNA, 17 bp, Homo sapiens
acaagaacaactgcagg

SEQ ID NO: 8693 - DNA, 17 bp, Homo sapiens
caagaacaactgcaggt

SEQ ID NO: 8694 - DNA, 17 bp, Homo sapiens
aagaacaactgcaggtg

SEQ ID NO: 8695 - DNA, 17 bp, Homo sapiens
agaacaactgcaggtgg

SEQ ID NO: 8696 - DNA, 17 bp, Homo sapiens
gaacaactgcaggtggc

SEQ ID NO: 8697 - DNA, 17 bp, Homo sapiens
aacaactgcaggtggct

SEQ ID NO: 8698 - DNA, 17 bp, Homo sapiens
acaactgcaggtggctc

SEQ ID NO: 8699 - DNA, 17 bp, Homo sapiens
caactgcaggtggctca

SEQ ID NO: 8700 - DNA, 17 bp, Homo sapiens
aactgcaggtggctcag

SEQ ID NO: 8701 - DNA, 17 bp, Homo sapiens
actgcaggtggctcaga

SEQ ID NO: 8702 - DNA, 17 bp, Homo sapiens
ctgcaggtggctcagat

SEQ ID NO: 8703 - DNA, 17 bp, Homo sapiens
tgcaggtggctcagatg

SEQ ID NO: 8704 - DNA, 17 bp, Homo sapiens
gcaggtggctcagatgc

SEQ ID NO: 8705 - DNA, 17 bp, Homo sapiens
caggtggctcagatgcg

SEQ ID NO: 8706 - DNA, 17 bp, Homo sapiens
aggtggctcagatgcgc

SEQ ID NO: 8707 - DNA, 17 bp, Homo sapiens
ggtggctcagatgcgca

SEQ ID NO: 8708 - DNA, 17 bp, Homo sapiens
gtggctcagatgcgcat

SEQ ID NO: 8709 - DNA, 17 bp, Homo sapiens
tggctcagatgcgcatc

SEQ ID NO: 8710 - DNA, 17 bp, Homo sapiens
ggctcagatgcgcatcg

SEQ ID NO: 8711 - DNA, 17 bp, Homo sapiens
gctcagatgcgcatcga

SEQ ID NO: 8712 - DNA, 17 bp, Homo sapiens
ctcagatgcgcatcgag

SEQ ID NO: 8713 - DNA, 17 bp, Homo sapiens
tcagatgcgcatcgagt

SEQ ID NO: 8714 - DNA, 17 bp, Homo sapiens
cagatgcgcatcgagta

SEQ ID NO: 8715 - DNA, 17 bp, Homo sapiens
agatgcgcatcgagtac

SEQ ID NO: 8716 - DNA, 17 bp, Homo sapiens
gatgcgcatcgagtacc

SEQ ID NO: 8717 - DNA, 17 bp, Homo sapiens
atgcgcatcgagtacct

SEQ ID NO: 8718 - DNA, 17 bp, Homo sapiens
tgcgcatcgagtacctg

SEQ ID NO: 8719 - DNA, 17 bp, Homo sapiens
gcgcatcgagtacctgg

SEQ ID NO: 8720 - DNA, 17 bp, Homo sapiens
cgcatcgagtacctgga

SEQ ID NO: 8721 - DNA, 17 bp, Homo sapiens
gcatcgagtacctggaa

SEQ ID NO: 8722 - DNA, 17 bp, Homo sapiens
catcgagtacctggaac

SEQ ID NO: 8723 - DNA, 17 bp, Homo sapiens
atcgagtacctggaaca

SEQ ID NO: 8724 - DNA, 17 bp, Homo sapiens
tcgagtacctggaacag

SEQ ID NO: 8725 - DNA, 17 bp, Homo sapiens
cgagtacctggaacagt

SEQ ID NO: 8726 - DNA, 17 bp, Homo sapiens
gagtacctggaacagtc

SEQ ID NO: 8727 - DNA, 17 bp, Homo sapiens
agtacctggaacagtcc

SEQ ID NO: 8728 - DNA, 17 bp, Homo sapiens
gtacctggaacagtcca

SEQ ID NO: 8729 - DNA, 17 bp, Homo sapiens
tacctggaacagtccac

SEQ ID NO: 8730 - DNA, 17 bp, Homo sapiens
acctggaacagtccacc

SEQ ID NO: 8731 - DNA, 17 bp, Homo sapiens
cctggaacagtccaccg

SEQ ID NO: 8732 - DNA, 17 bp, Homo sapiens
ctggaacagtccaccgt

SEQ ID NO: 8733 - DNA, 17 bp, Homo sapiens
tggaacagtccaccgtg

SEQ ID NO: 8734 - DNA, 17 bp, Homo sapiens
ggaacagtccaccgtgg

SEQ ID NO: 8735 - DNA, 17 bp, Homo sapiens
gaacagtccaccgtgga

SEQ ID NO: 8736 - DNA, 17 bp, Homo sapiens
aacagtccaccgtggat

SEQ ID NO: 8737 - DNA, 17 bp, Homo sapiens
acagtccaccgtggatc

SEQ ID NO: 8738 - DNA, 17 bp, Homo sapiens
cagtccaccgtggatcg

SEQ ID NO: 8739 - DNA, 17 bp, Homo sapiens
agtccaccgtggatcga

SEQ ID NO: 8740 - DNA, 17 bp, Homo sapiens
gtccaccgtggatcgag

SEQ ID NO: 8741 - DNA, 17 bp, Homo sapiens
tccaccgtggatcgagc

SEQ ID NO: 8742 - DNA, 17 bp, Homo sapiens
ccaccgtggatcgagcc

SEQ ID NO: 8743 - DNA, 17 bp, Homo sapiens
caccgtggatcgagcca

SEQ ID NO: 8744 - DNA, 17 bp, Homo sapiens
accgtggatcgagccat

SEQ ID NO: 8745 - DNA, 17 bp, Homo sapiens
ccgtggatcgagccatc

SEQ ID NO: 8746 - DNA, 17 bp, Homo sapiens
cgtggatcgagccatcg

SEQ ID NO: 8747 - DNA, 17 bp, Homo sapiens
gtggatcgagccatcgt

SEQ ID NO: 8748 - DNA, 17 bp, Homo sapiens
tggatcgagccatcgtc

SEQ ID NO: 8749 - DNA, 17 bp, Homo sapiens
ggatcgagccatcgtca

SEQ ID NO: 8750 - DNA, 17 bp, Homo sapiens
gatcgagccatcgtcag

SEQ ID NO: 8751 - DNA, 17 bp, Homo sapiens
atcgagccatcgtcagc

SEQ ID NO: 8752 - DNA, 17 bp, Homo sapiens
tcgagccatcgtcagca

SEQ ID NO: 8753 - DNA, 17 bp, Homo sapiens
cgagccatcgtcagcag

SEQ ID NO: 8754 - DNA, 17 bp, Homo sapiens
gagccatcgtcagcagg

SEQ ID NO: 8755 - DNA, 17 bp, Homo sapiens
agccatcgtcagcaggc

SEQ ID NO: 8756 - DNA, 17 bp, Homo sapiens
gccatcgtcagcaggca

SEQ ID NO: 8757 - DNA, 17 bp, Homo sapiens
ccatcgtcagcaggcag

SEQ ID NO: 8758 - DNA, 17 bp, Homo sapiens
catcgtcagcaggcagg

SEQ ID NO: 8759 - DNA, 17 bp, Homo sapiens
atcgtcagcaggcagga

SEQ ID NO: 8760 - DNA, 17 bp, Homo sapiens
tcgtcagcaggcaggag

SEQ ID NO: 8761 - DNA, 17 bp, Homo sapiens
cgtcagcaggcaggagg

SEQ ID NO: 8762 - DNA, 17 bp, Homo sapiens
gtcagcaggcaggaggc

SEQ ID NO: 8763 - DNA, 17 bp, Homo sapiens
tcagcaggcaggaggcg

SEQ ID NO: 8764 - DNA, 17 bp, Homo sapiens
cagcaggcaggaggcgg

SEQ ID NO: 8765 - DNA, 17 bp, Homo sapiens
agcaggcaggaggcggt

SEQ ID NO: 8766 - DNA, 17 bp, Homo sapiens
gcaggcaggaggcggtc

SEQ ID NO: 8767 - DNA, 17 bp, Homo sapiens
caggcaggaggcggtca

SEQ ID NO: 8768 - DNA, 17 bp, Homo sapiens
aggcaggaggcggtcat

SEQ ID NO: 8769 - DNA, 17 bp, Homo sapiens
ggcaggaggcggtcatc

SEQ ID NO: 8770 - DNA, 17 bp, Homo sapiens
gcaggaggcggtcatct

SEQ ID NO: 8771 - DNA, 17 bp, Homo sapiens
caggaggcggtcatctg

SEQ ID NO: 8772 - DNA, 17 bp, Homo sapiens
aggaggcggtcatctgt

SEQ ID NO: 8773 - DNA, 17 bp, Homo sapiens
ggaggcggtcatctgtg

SEQ ID NO: 8774 - DNA, 17 bp, Homo sapiens
gaggcggtcatctgtga

SEQ ID NO: 8775 - DNA, 17 bp, Homo sapiens
aggcggtcatctgtgac

SEQ ID NO: 8776 - DNA, 17 bp, Homo sapiens
ggcggtcatctgtgacc

SEQ ID NO: 8777 - DNA, 17 bp, Homo sapiens
gcggtcatctgtgacct

SEQ ID NO: 8778 - DNA, 17 bp, Homo sapiens
cggtcatctgtgaccta

SEQ ID NO: 8779 - DNA, 17 bp, Homo sapiens
ggtcatctgtgacctag

SEQ ID NO: 8780 - DNA, 17 bp, Homo sapiens
gtcatctgtgacctaga

SEQ ID NO: 8781 - DNA, 17 bp, Homo sapiens
tcatctgtgacctagag

SEQ ID NO: 8782 - DNA, 17 bp, Homo sapiens
catctgtgacctagaga

SEQ ID NO: 8783 - DNA, 17 bp, Homo sapiens
atctgtgacctagagaa

SEQ ID NO: 8784 - DNA, 17 bp, Homo sapiens
tctgtgacctagagaac

SEQ ID NO: 8785 - DNA, 17 bp, Homo sapiens
ctgtgacctagagaaca

SEQ ID NO: 8786 - DNA, 17 bp, Homo sapiens
tgtgacctagagaacaa

SEQ ID NO: 8787 - DNA, 17 bp, Homo sapiens
gtgacctagagaacaag

SEQ ID NO: 8788 - DNA, 17 bp, Homo sapiens
tgacctagagaacaaga

SEQ ID NO: 8789 - DNA, 17 bp, Homo sapiens
gacctagagaacaagac

SEQ ID NO: 8790 - DNA, 17 bp, Homo sapiens
acctagagaacaagaca

SEQ ID NO: 8791 - DNA, 17 bp, Homo sapiens
cctagagaacaagacag

SEQ ID NO: 8792 - DNA, 17 bp, Homo sapiens
ctagagaacaagacaga

SEQ ID NO: 8793 - DNA, 17 bp, Homo sapiens
tagagaacaagacagag

SEQ ID NO: 8794 - DNA, 17 bp, Homo sapiens
agagaacaagacagagt

SEQ ID NO: 8795 - DNA, 17 bp, Homo sapiens
gagaacaagacagagtt

SEQ ID NO: 8796 - DNA, 17 bp, Homo sapiens
agaacaagacagagttc

SEQ ID NO: 8797 - DNA, 17 bp, Homo sapiens
gaacaagacagagttcc

SEQ ID NO: 8798 - DNA, 17 bp, Homo sapiens
aacaagacagagttcca

SEQ ID NO: 8799 - DNA, 17 bp, Homo sapiens
acaagacagagttccag

SEQ ID NO: 8800 - DNA, 17 bp, Homo sapiens
caagacagagttccaga

SEQ ID NO: 8801 - DNA, 17 bp, Homo sapiens
aagacagagttccagaa

SEQ ID NO: 8802 - DNA, 17 bp, Homo sapiens
agacagagttccagaag

SEQ ID NO: 8803 - DNA, 17 bp, Homo sapiens
gacagagttccagaagg

SEQ ID NO: 8804 - DNA, 17 bp, Homo sapiens
acagagttccagaaggt

SEQ ID NO: 8805 - DNA, 17 bp, Homo sapiens
cagagttccagaaggtg

SEQ ID NO: 8806 - DNA, 17 bp, Homo sapiens
agagttccagaaggtgc

SEQ ID NO: 8807 - DNA, 17 bp, Homo sapiens
gagttccagaaggtgca

SEQ ID NO: 8808 - DNA, 17 bp, Homo sapiens
agttccagaaggtgcag

SEQ ID NO: 8809 - DNA, 17 bp, Homo sapiens
gttccagaaggtgcaga

SEQ ID NO: 8810 - DNA, 17 bp, Homo sapiens
ttccagaaggtgcagat

SEQ ID NO: 8811 - DNA, 17 bp, Homo sapiens
tccagaaggtgcagatt

SEQ ID NO: 8812 - DNA, 17 bp, Homo sapiens
ccagaaggtgcagatta

SEQ ID NO: 8813 - DNA, 17 bp, Homo sapiens
cagaaggtgcagattaa

SEQ ID NO: 8814 - DNA, 17 bp, Homo sapiens
agaaggtgcagattaag

SEQ ID NO: 8815 - DNA, 17 bp, Homo sapiens
gaaggtgcagattaaga

SEQ ID NO: 8816 - DNA, 17 bp, Homo sapiens
aaggtgcagattaagag

SEQ ID NO: 8817 - DNA, 17 bp, Homo sapiens
aggtgcagattaagaga

SEQ ID NO: 8818 - DNA, 17 bp, Homo sapiens
ggtgcagattaagagat

SEQ ID NO: 8819 - DNA, 17 bp, Homo sapiens
gtgcagattaagagatt

SEQ ID NO: 8820 - DNA, 17 bp, Homo sapiens
tgcagattaagagattt

SEQ ID NO: 8821 - DNA, 17 bp, Homo sapiens
gcagattaagagatttg

SEQ ID NO: 8822 - DNA, 17 bp, Homo sapiens
cagattaagagatttga

SEQ ID NO: 8823 - DNA, 17 bp, Homo sapiens
agattaagagatttgag

SEQ ID NO: 8824 - DNA, 17 bp, Homo sapiens
gattaagagatttgagg

SEQ ID NO: 8825 - DNA, 17 bp, Homo sapiens
attaagagatttgaggt

SEQ ID NO: 8826 - DNA, 17 bp, Homo sapiens
ttaagagatttgaggtc

SEQ ID NO: 8827 - DNA, 17 bp, Homo sapiens
taagagatttgaggtcc

SEQ ID NO: 8828 - DNA, 17 bp, Homo sapiens
aagagatttgaggtcct

SEQ ID NO: 8829 - DNA, 17 bp, Homo sapiens
agagatttgaggtcctg

SEQ ID NO: 8830 - DNA, 17 bp, Homo sapiens
gagatttgaggtcctgg

SEQ ID NO: 8831 - DNA, 17 bp, Homo sapiens
agatttgaggtcctggt

SEQ ID NO: 8832 - DNA, 17 bp, Homo sapiens
gatttgaggtcctggtg

SEQ ID NO: 8833 - DNA, 17 bp, Homo sapiens
atttgaggtcctggtga

SEQ ID NO: 8834 - DNA, 17 bp, Homo sapiens
tttgaggtcctggtgat

SEQ ID NO: 8835 - DNA, 17 bp, Homo sapiens
ttgaggtcctggtgatc

SEQ ID NO: 8836 - DNA, 17 bp, Homo sapiens
tgaggtcctggtgatcc

SEQ ID NO: 8837 - DNA, 17 bp, Homo sapiens
gaggtcctggtgatccg

SEQ ID NO: 8838 - DNA, 17 bp, Homo sapiens
aggtcctggtgatccgg

SEQ ID NO: 8839 - DNA, 17 bp, Homo sapiens
ggtcctggtgatccggc

SEQ ID NO: 8840 - DNA, 17 bp, Homo sapiens
gtcctggtgatccggct

SEQ ID NO: 8841 - DNA, 17 bp, Homo sapiens
tcctggtgatccggctt

SEQ ID NO: 8842 - DNA, 17 bp, Homo sapiens
cctggtgatccggcttc

SEQ ID NO: 8843 - DNA, 17 bp, Homo sapiens
ctggtgatccggcttcg

SEQ ID NO: 8844 - DNA, 17 bp, Homo sapiens
tggtgatccggcttcgg

SEQ ID NO: 8845 - DNA, 17 bp, Homo sapiens
ggtgatccggcttcggg

SEQ ID NO: 8846 - DNA, 17 bp, Homo sapiens
gtgatccggcttcggga

SEQ ID NO: 8847 - DNA, 17 bp, Homo sapiens
tgatccggcttcgggac

SEQ ID NO: 8848 - DNA, 17 bp, Homo sapiens
gatccggcttcgggaca

SEQ ID NO: 8849 - DNA, 17 bp, Homo sapiens
atccggcttcgggacag

SEQ ID NO: 8850 - DNA, 17 bp, Homo sapiens
tccggcttcgggacagc

SEQ ID NO: 8851 - DNA, 17 bp, Homo sapiens
ccggcttcgggacagcc

SEQ ID NO: 8852 - DNA, 17 bp, Homo sapiens
cggcttcgggacagcct

SEQ ID NO: 8853 - DNA, 17 bp, Homo sapiens
ggcttcgggacagcctg

SEQ ID NO: 8854 - DNA, 17 bp, Homo sapiens
gcttcgggacagcctga

SEQ ID NO: 8855 - DNA, 17 bp, Homo sapiens
cttcgggacagcctgat

SEQ ID NO: 8856 - DNA, 17 bp, Homo sapiens
ttcgggacagcctgatc

SEQ ID NO: 8857 - DNA, 17 bp, Homo sapiens
tcgggacagcctgatca

SEQ ID NO: 8858 - DNA, 17 bp, Homo sapiens
cgggacagcctgatcaa

SEQ ID NO: 8859 - DNA, 17 bp, Homo sapiens
gggacagcctgatcaag

SEQ ID NO: 8860 - DNA, 17 bp, Homo sapiens
ggacagcctgatcaaga

SEQ ID NO: 8861 - DNA, 17 bp, Homo sapiens
gacagcctgatcaagat

SEQ ID NO: 8862 - DNA, 17 bp, Homo sapiens
acagcctgatcaagatg

SEQ ID NO: 8863 - DNA, 17 bp, Homo sapiens
cagcctgatcaagatgg

SEQ ID NO: 8864 - DNA, 17 bp, Homo sapiens
agcctgatcaagatggg

SEQ ID NO: 8865 - DNA, 17 bp, Homo sapiens
gcctgatcaagatgggg

SEQ ID NO: 8866 - DNA, 17 bp, Homo sapiens
cctgatcaagatggggg

SEQ ID NO: 8867 - DNA, 17 bp, Homo sapiens
ctgatcaagatggggga

SEQ ID NO: 8868 - DNA, 17 bp, Homo sapiens
tgatcaagatgggggag

SEQ ID NO: 8869 - DNA, 17 bp, Homo sapiens
gatcaagatgggggagg

SEQ ID NO: 8870 - DNA, 17 bp, Homo sapiens
atcaagatgggggagga

SEQ ID NO: 8871 - DNA, 17 bp, Homo sapiens
tcaagatgggggaggag

SEQ ID NO: 8872 - DNA, 17 bp, Homo sapiens
caagatgggggaggagc

SEQ ID NO: 8873 - DNA, 17 bp, Homo sapiens
aagatgggggaggagct

SEQ ID NO: 8874 - DNA, 17 bp, Homo sapiens
agatgggggaggagctt

SEQ ID NO: 8875 - DNA, 17 bp, Homo sapiens
gatgggggaggagcttt

SEQ ID NO: 8876 - DNA, 17 bp, Homo sapiens
atgggggaggagctttc

SEQ ID NO: 8877 - DNA, 17 bp, Homo sapiens
tgggggaggagctttca

SEQ ID NO: 8878 - DNA, 17 bp, Homo sapiens
gggggaggagctttcac

SEQ ID NO: 8879 - DNA, 17 bp, Homo sapiens
ggggaggagctttcaca

SEQ ID NO: 8880 - DNA, 17 bp, Homo sapiens
gggaggagctttcacag

SEQ ID NO: 8881 - DNA, 17 bp, Homo sapiens
ggaggagctttcacagg

SEQ ID NO: 8882 - DNA, 17 bp, Homo sapiens
gaggagctttcacaggc

SEQ ID NO: 8883 - DNA, 17 bp, Homo sapiens
aggagctttcacaggcg

SEQ ID NO: 8884 - DNA, 17 bp, Homo sapiens
ggagctttcacaggcgg

SEQ ID NO: 8885 - DNA, 17 bp, Homo sapiens
gagctttcacaggcggc

SEQ ID NO: 8886 - DNA, 17 bp, Homo sapiens
agctttcacaggcggcc

SEQ ID NO: 8887 - DNA, 17 bp, Homo sapiens
gctttcacaggcggcca

SEQ ID NO: 8888 - DNA, 17 bp, Homo sapiens
ctttcacaggcggccac

SEQ ID NO: 8889 - DNA, 17 bp, Homo sapiens
tttcacaggcggccacc

SEQ ID NO: 8890 - DNA, 17 bp, Homo sapiens
ttcacaggcggccacct

SEQ ID NO: 8891 - DNA, 17 bp, Homo sapiens
tcacaggcggccacctc

SEQ ID NO: 8892 - DNA, 17 bp, Homo sapiens
cacaggcggccacctcc

SEQ ID NO: 8893 - DNA, 17 bp, Homo sapiens
acaggcggccacctccg

SEQ ID NO: 8894 - DNA, 17 bp, Homo sapiens
caggcggccacctccga

SEQ ID NO: 8895 - DNA, 17 bp, Homo sapiens
aggcggccacctccgag

SEQ ID NO: 8896 - DNA, 17 bp, Homo sapiens
ggcggccacctccgagt

SEQ ID NO: 8897 - DNA, 17 bp, Homo sapiens
gcggccacctccgagtc

SEQ ID NO: 8898 - DNA, 17 bp, Homo sapiens
cggccacctccgagtcc

SEQ ID NO: 8899 - DNA, 17 bp, Homo sapiens
ggccacctccgagtccc

SEQ ID NO: 8900 - DNA, 17 bp, Homo sapiens
gccacctccgagtccca

SEQ ID NO: 8901 - DNA, 17 bp, Homo sapiens
ccacctccgagtcccag

SEQ ID NO: 8902 - DNA, 17 bp, Homo sapiens
cacctccgagtcccagc

SEQ ID NO: 8903 - DNA, 17 bp, Homo sapiens
acctccgagtcccagca

SEQ ID NO: 8904 - DNA, 17 bp, Homo sapiens
cctccgagtcccagcag

SEQ ID NO: 8905 - DNA, 17 bp, Homo sapiens
ctccgagtcccagcagc

SEQ ID NO: 8906 - DNA, 17 bp, Homo sapiens
tccgagtcccagcagcg

SEQ ID NO: 8907 - DNA, 17 bp, Homo sapiens
ccgagtcccagcagcgg

SEQ ID NO: 8908 - DNA, 17 bp, Homo sapiens
cgagtcccagcagcggg

SEQ ID NO: 8909 - DNA, 17 bp, Homo sapiens
gagtcccagcagcggga

SEQ ID NO: 8910 - DNA, 17 bp, Homo sapiens
agtcccagcagcgggag

SEQ ID NO: 8911 - DNA, 17 bp, Homo sapiens
gtcccagcagcgggaga

SEQ ID NO: 8912 - DNA, 17 bp, Homo sapiens
tcccagcagcgggagag

SEQ ID NO: 8913 - DNA, 17 bp, Homo sapiens
cccagcagcgggagagc

SEQ ID NO: 8914 - DNA, 17 bp, Homo sapiens
ccagcagcgggagagca

SEQ ID NO: 8915 - DNA, 17 bp, Homo sapiens
cagcagcgggagagcag

SEQ ID NO: 8916 - DNA, 17 bp, Homo sapiens
agcagcgggagagcagc

SEQ ID NO: 8917 - DNA, 17 bp, Homo sapiens
gcagcgggagagcagcc

SEQ ID NO: 8918 - DNA, 17 bp, Homo sapiens
cagcgggagagcagcca

SEQ ID NO: 8919 - DNA, 17 bp, Homo sapiens
agcgggagagcagccag

SEQ ID NO: 8920 - DNA, 17 bp, Homo sapiens
gcgggagagcagccagt

SEQ ID NO: 8921 - DNA, 17 bp, Homo sapiens
cgggagagcagccagta

SEQ ID NO: 8922 - DNA, 17 bp, Homo sapiens
gggagagcagccagtac

SEQ ID NO: 8923 - DNA, 17 bp, Homo sapiens
ggagagcagccagtact

SEQ ID NO: 8924 - DNA, 17 bp, Homo sapiens
gagagcagccagtacta

SEQ ID NO: 8925 - DNA, 17 bp, Homo sapiens
agagcagccagtactac

SEQ ID NO: 8926 - DNA, 17 bp, Homo sapiens
gagcagccagtactacc

SEQ ID NO: 8927 - DNA, 17 bp, Homo sapiens
agcagccagtactacca

SEQ ID NO: 8928 - DNA, 17 bp, Homo sapiens
gcagccagtactaccag

SEQ ID NO: 8929 - DNA, 17 bp, Homo sapiens
cagccagtactaccagc

SEQ ID NO: 8930 - DNA, 17 bp, Homo sapiens
agccagtactaccagcg

SEQ ID NO: 8931 - DNA, 17 bp, Homo sapiens
gccagtactaccagcgg

SEQ ID NO: 8932 - DNA, 17 bp, Homo sapiens
ccagtactaccagcggc

SEQ ID NO: 8933 - DNA, 17 bp, Homo sapiens
cagtactaccagcggcg

SEQ ID NO: 8934 - DNA, 17 bp, Homo sapiens
agtactaccagcggcgc

SEQ ID NO: 8935 - DNA, 17 bp, Homo sapiens
gtactaccagcggcgcc

SEQ ID NO: 8936 - DNA, 17 bp, Homo sapiens
tactaccagcggcgcct

SEQ ID NO: 8937 - DNA, 17 bp, Homo sapiens
actaccagcggcgcctg

SEQ ID NO: 8938 - DNA, 17 bp, Homo sapiens
ctaccagcggcgcctgg

SEQ ID NO: 8939 - DNA, 17 bp, Homo sapiens
taccagcggcgcctgga

SEQ ID NO: 8940 - DNA, 17 bp, Homo sapiens
accagcggcgcctggaa

SEQ ID NO: 8941 - DNA, 17 bp, Homo sapiens
ccagcggcgcctggaag

SEQ ID NO: 8942 - DNA, 17 bp, Homo sapiens
cagcggcgcctggaaga

SEQ ID NO: 8943 - DNA, 17 bp, Homo sapiens
agcggcgcctggaagag

SEQ ID NO: 8944 - DNA, 17 bp, Homo sapiens
gcggcgcctggaagagc

SEQ ID NO: 8945 - DNA, 17 bp, Homo sapiens
cggcgcctggaagagct

SEQ ID NO: 8946 - DNA, 17 bp, Homo sapiens
ggcgcctggaagagctg

SEQ ID NO: 8947 - DNA, 17 bp, Homo sapiens
gcgcctggaagagctga

SEQ ID NO: 8948 - DNA, 17 bp, Homo sapiens
cgcctggaagagctgaa

SEQ ID NO: 8949 - DNA, 17 bp, Homo sapiens
gcctggaagagctgaag

SEQ ID NO: 8950 - DNA, 17 bp, Homo sapiens
cctggaagagctgaagg

SEQ ID NO: 8951 - DNA, 17 bp, Homo sapiens
ctggaagagctgaaggc

SEQ ID NO: 8952 - DNA, 17 bp, Homo sapiens
tggaagagctgaaggcc

SEQ ID NO: 8953 - DNA, 17 bp, Homo sapiens
ggaagagctgaaggccg

SEQ ID NO: 8954 - DNA, 17 bp, Homo sapiens
gaagagctgaaggccga

SEQ ID NO: 8955 - DNA, 17 bp, Homo sapiens
aagagctgaaggccgac

SEQ ID NO: 8956 - DNA, 17 bp, Homo sapiens
agagctgaaggccgaca

SEQ ID NO: 8957 - DNA, 17 bp, Homo sapiens
gagctgaaggccgacat

SEQ ID NO: 8958 - DNA, 17 bp, Homo sapiens
agctgaaggccgacatg

SEQ ID NO: 8959 - DNA, 17 bp, Homo sapiens
gctgaaggccgacatgg

SEQ ID NO: 8960 - DNA, 17 bp, Homo sapiens
ctgaaggccgacatgga

SEQ ID NO: 8961 - DNA, 17 bp, Homo sapiens
tgaaggccgacatggaa

SEQ ID NO: 8962 - DNA, 17 bp, Homo sapiens
gaaggccgacatggaag

SEQ ID NO: 8963 - DNA, 17 bp, Homo sapiens
aaggccgacatggaaga

SEQ ID NO: 8964 - DNA, 17 bp, Homo sapiens
aggccgacatggaagag

SEQ ID NO: 8965 - DNA, 17 bp, Homo sapiens
ggccgacatggaagagc

SEQ ID NO: 8966 - DNA, 17 bp, Homo sapiens
gccgacatggaagagct

SEQ ID NO: 8967 - DNA, 17 bp, Homo sapiens
ccgacatggaagagctg

SEQ ID NO: 8968 - DNA, 17 bp, Homo sapiens
cgacatggaagagctgg

SEQ ID NO: 8969 - DNA, 17 bp, Homo sapiens
gacatggaagagctggt

SEQ ID NO: 8970 - DNA, 17 bp, Homo sapiens
acatggaagagctggtg

SEQ ID NO: 8971 - DNA, 17 bp, Homo sapiens
catggaagagctggtgc

SEQ ID NO: 8972 - DNA, 17 bp, Homo sapiens
atggaagagctggtgca

SEQ ID NO: 8973 - DNA, 17 bp, Homo sapiens
tggaagagctggtgcag

SEQ ID NO: 8974 - DNA, 17 bp, Homo sapiens
ggaagagctggtgcagc

SEQ ID NO: 8975 - DNA, 17 bp, Homo sapiens
gaagagctggtgcagcg

SEQ ID NO: 8976 - DNA, 17 bp, Homo sapiens
aagagctggtgcagcgg

SEQ ID NO: 8977 - DNA, 17 bp, Homo sapiens
agagctggtgcagcggg

SEQ ID NO: 8978 - DNA, 17 bp, Homo sapiens
gagctggtgcagcggga

SEQ ID NO: 8979 - DNA, 17 bp, Homo sapiens
agctggtgcagcgggag

SEQ ID NO: 8980 - DNA, 17 bp, Homo sapiens
gctggtgcagcgggagg

SEQ ID NO: 8981 - DNA, 17 bp, Homo sapiens
ctggtgcagcgggaggc

SEQ ID NO: 8982 - DNA, 17 bp, Homo sapiens
tggtgcagcgggaggca

SEQ ID NO: 8983 - DNA, 17 bp, Homo sapiens
ggtgcagcgggaggcag

SEQ ID NO: 8984 - DNA, 17 bp, Homo sapiens
gtgcagcgggaggcaga

SEQ ID NO: 8985 - DNA, 17 bp, Homo sapiens
tgcagcgggaggcagag

SEQ ID NO: 8986 - DNA, 17 bp, Homo sapiens
gcagcgggaggcagagg

SEQ ID NO: 8987 - DNA, 17 bp, Homo sapiens
cagcgggaggcagaggc

SEQ ID NO: 8988 - DNA, 17 bp, Homo sapiens
agcgggaggcagaggcc

SEQ ID NO: 8989 - DNA, 17 bp, Homo sapiens
gcgggaggcagaggcca

SEQ ID NO: 8990 - DNA, 17 bp, Homo sapiens
cgggaggcagaggccag

SEQ ID NO: 8991 - DNA, 17 bp, Homo sapiens
gggaggcagaggccagc

SEQ ID NO: 8992 - DNA, 17 bp, Homo sapiens
ggaggcagaggccagcc

SEQ ID NO: 8993 - DNA, 17 bp, Homo sapiens
gaggcagaggccagccg

SEQ ID NO: 8994 - DNA, 17 bp, Homo sapiens
aggcagaggccagccgg

SEQ ID NO: 8995 - DNA, 17 bp, Homo sapiens
ggcagaggccagccggc

SEQ ID NO: 8996 - DNA, 17 bp, Homo sapiens
gcagaggccagccggcg

SEQ ID NO: 8997 - DNA, 17 bp, Homo sapiens
cagaggccagccggcgg

SEQ ID NO: 8998 - DNA, 17 bp, Homo sapiens
agaggccagccggcggt

SEQ ID NO: 8999 - DNA, 17 bp, Homo sapiens
gaggccagccggcggtg

SEQ ID NO: 9000 - DNA, 17 bp, Homo sapiens
aggccagccggcggtgc

SEQ ID NO: 9001 - DNA, 17 bp, Homo sapiens
ggccagccggcggtgca

SEQ ID NO: 9002 - DNA, 17 bp, Homo sapiens
gccagccggcggtgcat

SEQ ID NO: 9003 - DNA, 17 bp, Homo sapiens
ccagccggcggtgcatg

SEQ ID NO: 9004 - DNA, 17 bp, Homo sapiens
cagccggcggtgcatgg

SEQ ID NO: 9005 - DNA, 17 bp, Homo sapiens
agccggcggtgcatgga

SEQ ID NO: 9006 - DNA, 17 bp, Homo sapiens
gccggcggtgcatggag

SEQ ID NO: 9007 - DNA, 17 bp, Homo sapiens
ccggcggtgcatggagc

SEQ ID NO: 9008 - DNA, 17 bp, Homo sapiens
cggcggtgcatggagct

SEQ ID NO: 9009 - DNA, 17 bp, Homo sapiens
ggcggtgcatggagctg

SEQ ID NO: 9010 - DNA, 17 bp, Homo sapiens
gcggtgcatggagctgg

SEQ ID NO: 9011 - DNA, 17 bp, Homo sapiens
cggtgcatggagctgga

SEQ ID NO: 9012 - DNA, 17 bp, Homo sapiens
ggtgcatggagctggag

SEQ ID NO: 9013 - DNA, 17 bp, Homo sapiens
gtgcatggagctggaga

SEQ ID NO: 9014 - DNA, 17 bp, Homo sapiens
tgcatggagctggagaa

SEQ ID NO: 9015 - DNA, 17 bp, Homo sapiens
gcatggagctggagaag

SEQ ID NO: 9016 - DNA, 17 bp, Homo sapiens
catggagctggagaagt

SEQ ID NO: 9017 - DNA, 17 bp, Homo sapiens
atggagctggagaagta

SEQ ID NO: 9018 - DNA, 17 bp, Homo sapiens
tggagctggagaagtac

SEQ ID NO: 9019 - DNA, 17 bp, Homo sapiens
ggagctggagaagtacg

SEQ ID NO: 9020 - DNA, 17 bp, Homo sapiens
gagctggagaagtacgt

SEQ ID NO: 9021 - DNA, 17 bp, Homo sapiens
agctggagaagtacgtg

SEQ ID NO: 9022 - DNA, 17 bp, Homo sapiens
gctggagaagtacgtgg

SEQ ID NO: 9023 - DNA, 17 bp, Homo sapiens
ctggagaagtacgtgga

SEQ ID NO: 9024 - DNA, 17 bp, Homo sapiens
tggagaagtacgtggag

SEQ ID NO: 9025 - DNA, 17 bp, Homo sapiens
ggagaagtacgtggagg

SEQ ID NO: 9026 - DNA, 17 bp, Homo sapiens
gagaagtacgtggagga

SEQ ID NO: 9027 - DNA, 17 bp, Homo sapiens
agaagtacgtggaggaa

SEQ ID NO: 9028 - DNA, 17 bp, Homo sapiens
gaagtacgtggaggaac

SEQ ID NO: 9029 - DNA, 17 bp, Homo sapiens
aagtacgtggaggaact

SEQ ID NO: 9030 - DNA, 17 bp, Homo sapiens
agtacgtggaggaactt

SEQ ID NO: 9031 - DNA, 17 bp, Homo sapiens
gtacgtggaggaacttg

SEQ ID NO: 9032 - DNA, 17 bp, Homo sapiens
tacgtggaggaacttgc

SEQ ID NO: 9033 - DNA, 17 bp, Homo sapiens
acgtggaggaacttgca

SEQ ID NO: 9034 - DNA, 17 bp, Homo sapiens
cgtggaggaacttgcag

SEQ ID NO: 9035 - DNA, 17 bp, Homo sapiens
gtggaggaacttgcagc

SEQ ID NO: 9036 - DNA, 17 bp, Homo sapiens
tggaggaacttgcagca

SEQ ID NO: 9037 - DNA, 17 bp, Homo sapiens
ggaggaacttgcagcag

SEQ ID NO: 9038 - DNA, 17 bp, Homo sapiens
gaggaacttgcagcagt

SEQ ID NO: 9039 - DNA, 17 bp, Homo sapiens
aggaacttgcagcagtg

SEQ ID NO: 9040 - DNA, 17 bp, Homo sapiens
ggaacttgcagcagtga

SEQ ID NO: 9041 - DNA, 17 bp, Homo sapiens
gaacttgcagcagtgag

SEQ ID NO: 9042 - DNA, 17 bp, Homo sapiens
aacttgcagcagtgagg

SEQ ID NO: 9043 - DNA, 17 bp, Homo sapiens
acttgcagcagtgaggc

SEQ ID NO: 9044 - DNA, 17 bp, Homo sapiens
cttgcagcagtgaggca

SEQ ID NO: 9045 - DNA, 17 bp, Homo sapiens
ttgcagcagtgaggcaa

SEQ ID NO: 9046 - DNA, 17 bp, Homo sapiens
tgcagcagtgaggcaaa

SEQ ID NO: 9047 - DNA, 17 bp, Homo sapiens
gcagcagtgaggcaaac

SEQ ID NO: 9048 - DNA, 17 bp, Homo sapiens
cagcagtgaggcaaacc

SEQ ID NO: 9049 - DNA, 17 bp, Homo sapiens
agcagtgaggcaaaccc

SEQ ID NO: 9050 - DNA, 17 bp, Homo sapiens
gcagtgaggcaaaccct

SEQ ID NO: 9051 - DNA, 17 bp, Homo sapiens
cagtgaggcaaaccctc

SEQ ID NO: 9052 - DNA, 17 bp, Homo sapiens
agtgaggcaaaccctcc

SEQ ID NO: 9053 - DNA, 17 bp, Homo sapiens
gtgaggcaaaccctcca

SEQ ID NO: 9054 - DNA, 17 bp, Homo sapiens
tgaggcaaaccctccag

SEQ ID NO: 9055 - DNA, 17 bp, Homo sapiens
gaggcaaaccctccaga

SEQ ID NO: 9056 - DNA, 17 bp, Homo sapiens
aggcaaaccctccagac

SEQ ID NO: 9057 - DNA, 17 bp, Homo sapiens
ggcaaaccctccagaca

SEQ ID NO: 9058 - DNA, 17 bp, Homo sapiens
gcaaaccctccagacag

SEQ ID NO: 9059 - DNA, 17 bp, Homo sapiens
caaaccctccagacaga

SEQ ID NO: 9060 - DNA, 17 bp, Homo sapiens
aaaccctccagacagac

SEQ ID NO: 9061 - DNA, 17 bp, Homo sapiens
aaccctccagacagacc

SEQ ID NO: 9062 - DNA, 17 bp, Homo sapiens
accctccagacagacct

SEQ ID NO: 9063 - DNA, 17 bp, Homo sapiens
ccctccagacagacctg

SEQ ID NO: 9064 - DNA, 17 bp, Homo sapiens
cctccagacagacctgg

SEQ ID NO: 9065 - DNA, 17 bp, Homo sapiens
ctccagacagacctgga

SEQ ID NO: 9066 - DNA, 17 bp, Homo sapiens
tccagacagacctggag

SEQ ID NO: 9067 - DNA, 17 bp, Homo sapiens
ccagacagacctggaga

SEQ ID NO: 9068 - DNA, 17 bp, Homo sapiens
cagacagacctggagac

SEQ ID NO: 9069 - DNA, 17 bp, Homo sapiens
agacagacctggagaca

SEQ ID NO: 9070 - DNA, 17 bp, Homo sapiens
gacagacctggagacat

SEQ ID NO: 9071 - DNA, 17 bp, Homo sapiens
acagacctggagacatc

SEQ ID NO: 9072 - DNA, 17 bp, Homo sapiens
cagacctggagacatcc

SEQ ID NO: 9073 - DNA, 17 bp, Homo sapiens
agacctggagacatcca

SEQ ID NO: 9074 - DNA, 17 bp, Homo sapiens
gacctggagacatccat

SEQ ID NO: 9075 - DNA, 17 bp, Homo sapiens
acctggagacatccatt

SEQ ID NO: 9076 - DNA, 17 bp, Homo sapiens
cctggagacatccattc

SEQ ID NO: 9077 - DNA, 17 bp, Homo sapiens
ctggagacatccattcg

SEQ ID NO: 9078 - DNA, 17 bp, Homo sapiens
tggagacatccattcgg

SEQ ID NO: 9079 - DNA, 17 bp, Homo sapiens
ggagacatccattcggc

SEQ ID NO: 9080 - DNA, 17 bp, Homo sapiens
gagacatccattcggcg

SEQ ID NO: 9081 - DNA, 17 bp, Homo sapiens
agacatccattcggcgg

SEQ ID NO: 9082 - DNA, 17 bp, Homo sapiens
gacatccattcggcgga

SEQ ID NO: 9083 - DNA, 17 bp, Homo sapiens
acatccattcggcggat

SEQ ID NO: 9084 - DNA, 17 bp, Homo sapiens
catccattcggcggatt

SEQ ID NO: 9085 - DNA, 17 bp, Homo sapiens
atccattcggcggattg

SEQ ID NO: 9086 - DNA, 17 bp, Homo sapiens
tccattcggcggattgc

SEQ ID NO: 9087 - DNA, 17 bp, Homo sapiens
ccattcggcggattgcc

SEQ ID NO: 9088 - DNA, 17 bp, Homo sapiens
cattcggcggattgccg

SEQ ID NO: 9089 - DNA, 17 bp, Homo sapiens
attcggcggattgccga

SEQ ID NO: 9090 - DNA, 17 bp, Homo sapiens
ttcggcggattgccgac

SEQ ID NO: 9091 - DNA, 17 bp, Homo sapiens
tcggcggattgccgacc

SEQ ID NO: 9092 - DNA, 17 bp, Homo sapiens
cggcggattgccgacct

SEQ ID NO: 9093 - DNA, 17 bp, Homo sapiens
ggcggattgccgacctg

SEQ ID NO: 9094 - DNA, 17 bp, Homo sapiens
gcggattgccgacctgc

SEQ ID NO: 9095 - DNA, 17 bp, Homo sapiens
cggattgccgacctgca

SEQ ID NO: 9096 - DNA, 17 bp, Homo sapiens
ggattgccgacctgcag

SEQ ID NO: 9097 - DNA, 17 bp, Homo sapiens
gattgccgacctgcagg

SEQ ID NO: 9098 - DNA, 17 bp, Homo sapiens
attgccgacctgcaggc

SEQ ID NO: 9099 - DNA, 17 bp, Homo sapiens
ttgccgacctgcaggct

SEQ ID NO: 9100 - DNA, 17 bp, Homo sapiens
tgccgacctgcaggctg

SEQ ID NO: 9101 - DNA, 17 bp, Homo sapiens
gccgacctgcaggctgc

SEQ ID NO: 9102 - DNA, 17 bp, Homo sapiens
ccgacctgcaggctgcc

SEQ ID NO: 9103 - DNA, 17 bp, Homo sapiens
cgacctgcaggctgcct

SEQ ID NO: 9104 - DNA, 17 bp, Homo sapiens
gacctgcaggctgcctt

SEQ ID NO: 9105 - DNA, 17 bp, Homo sapiens
acctgcaggctgccttg

SEQ ID NO: 9106 - DNA, 17 bp, Homo sapiens
cctgcaggctgccttgg

SEQ ID NO: 9107 - DNA, 17 bp, Homo sapiens
ctgcaggctgccttgga

SEQ ID NO: 9108 - DNA, 17 bp, Homo sapiens
tgcaggctgccttggaa

SEQ ID NO: 9109 - DNA, 17 bp, Homo sapiens
gcaggctgccttggaag

SEQ ID NO: 9110 - DNA, 17 bp, Homo sapiens
caggctgccttggaaga

SEQ ID NO: 9111 - DNA, 17 bp, Homo sapiens
aggctgccttggaagaa

SEQ ID NO: 9112 - DNA, 17 bp, Homo sapiens
ggctgccttggaagaag

SEQ ID NO: 9113 - DNA, 17 bp, Homo sapiens
gctgccttggaagaagt

SEQ ID NO: 9114 - DNA, 17 bp, Homo sapiens
ctgccttggaagaagtg

SEQ ID NO: 9115 - DNA, 17 bp, Homo sapiens
tgccttggaagaagtgg

SEQ ID NO: 9116 - DNA, 17 bp, Homo sapiens
gccttggaagaagtggc

SEQ ID NO: 9117 - DNA, 17 bp, Homo sapiens
ccttggaagaagtggca

SEQ ID NO: 9118 - DNA, 17 bp, Homo sapiens
cttggaagaagtggcat

SEQ ID NO: 9119 - DNA, 17 bp, Homo sapiens
ttggaagaagtggcatc

SEQ ID NO: 9120 - DNA, 17 bp, Homo sapiens
tggaagaagtggcatcc

SEQ ID NO: 9121 - DNA, 17 bp, Homo sapiens
ggaagaagtggcatcca

SEQ ID NO: 9122 - DNA, 17 bp, Homo sapiens
gaagaagtggcatccag

SEQ ID NO: 9123 - DNA, 17 bp, Homo sapiens
aagaagtggcatccagt

SEQ ID NO: 9124 - DNA, 17 bp, Homo sapiens
agaagtggcatccagtg

SEQ ID NO: 9125 - DNA, 17 bp, Homo sapiens
gaagtggcatccagtga

SEQ ID NO: 9126 - DNA, 17 bp, Homo sapiens
aagtggcatccagtgac

SEQ ID NO: 9127 - DNA, 17 bp, Homo sapiens
agtggcatccagtgaca

SEQ ID NO: 9128 - DNA, 17 bp, Homo sapiens
gtggcatccagtgacag

SEQ ID NO: 9129 - DNA, 17 bp, Homo sapiens
tggcatccagtgacagt

SEQ ID NO: 9130 - DNA, 17 bp, Homo sapiens
ggcatccagtgacagtg

SEQ ID NO: 9131 - DNA, 17 bp, Homo sapiens
gcatccagtgacagtga

SEQ ID NO: 9132 - DNA, 17 bp, Homo sapiens
catccagtgacagtgat

SEQ ID NO: 9133 - DNA, 17 bp, Homo sapiens
atccagtgacagtgata

SEQ ID NO: 9134 - DNA, 17 bp, Homo sapiens
tccagtgacagtgatac

SEQ ID NO: 9135 - DNA, 17 bp, Homo sapiens
ccagtgacagtgatact

SEQ ID NO: 9136 - DNA, 17 bp, Homo sapiens
cagtgacagtgatactg

SEQ ID NO: 9137 - DNA, 17 bp, Homo sapiens
agtgacagtgatactga

SEQ ID NO: 9138 - DNA, 17 bp, Homo sapiens
gtgacagtgatactgag

SEQ ID NO: 9139 - DNA, 17 bp, Homo sapiens
tgacagtgatactgaga

SEQ ID NO: 9140 - DNA, 17 bp, Homo sapiens
gacagtgatactgagag

SEQ ID NO: 9141 - DNA, 17 bp, Homo sapiens
acagtgatactgagagt

SEQ ID NO: 9142 - DNA, 17 bp, Homo sapiens
cagtgatactgagagtg

SEQ ID NO: 9143 - DNA, 17 bp, Homo sapiens
agtgatactgagagtgt

SEQ ID NO: 9144 - DNA, 17 bp, Homo sapiens
gtgatactgagagtgtc

SEQ ID NO: 9145 - DNA, 17 bp, Homo sapiens
tgatactgagagtgtcc

SEQ ID NO: 9146 - DNA, 17 bp, Homo sapiens
gatactgagagtgtcca

SEQ ID NO: 9147 - DNA, 17 bp, Homo sapiens
atactgagagtgtccag

SEQ ID NO: 9148 - DNA, 17 bp, Homo sapiens
tactgagagtgtccaga

SEQ ID NO: 9149 - DNA, 17 bp, Homo sapiens
actgagagtgtccagac

SEQ ID NO: 9150 - DNA, 17 bp, Homo sapiens
ctgagagtgtccagacg

SEQ ID NO: 9151 - DNA, 17 bp, Homo sapiens
tgagagtgtccagacgg

SEQ ID NO: 9152 - DNA, 17 bp, Homo sapiens
gagagtgtccagacggc

SEQ ID NO: 9153 - DNA, 17 bp, Homo sapiens
agagtgtccagacggca

SEQ ID NO: 9154 - DNA, 17 bp, Homo sapiens
gagtgtccagacggcag

SEQ ID NO: 9155 - DNA, 17 bp, Homo sapiens
agtgtccagacggcagt

SEQ ID NO: 9156 - DNA, 17 bp, Homo sapiens
gtgtccagacggcagtg

SEQ ID NO: 9157 - DNA, 17 bp, Homo sapiens
tgtccagacggcagtgg

SEQ ID NO: 9158 - DNA, 17 bp, Homo sapiens
gtccagacggcagtgga

SEQ ID NO: 9159 - DNA, 17 bp, Homo sapiens
tccagacggcagtggat

SEQ ID NO: 9160 - DNA, 17 bp, Homo sapiens
ccagacggcagtggatt

SEQ ID NO: 9161 - DNA, 17 bp, Homo sapiens
cagacggcagtggattg

SEQ ID NO: 9162 - DNA, 17 bp, Homo sapiens
agacggcagtggattgt

SEQ ID NO: 9163 - DNA, 17 bp, Homo sapiens
gacggcagtggattgtg

SEQ ID NO: 9164 - DNA, 17 bp, Homo sapiens
acggcagtggattgtgg

SEQ ID NO: 9165 - DNA, 17 bp, Homo sapiens
cggcagtggattgtggc

SEQ ID NO: 9166 - DNA, 17 bp, Homo sapiens
ggcagtggattgtggca

SEQ ID NO: 9167 - DNA, 17 bp, Homo sapiens
gcagtggattgtggcag

SEQ ID NO: 9168 - DNA, 17 bp, Homo sapiens
cagtggattgtggcagc

SEQ ID NO: 9169 - DNA, 17 bp, Homo sapiens
agtggattgtggcagca

SEQ ID NO: 9170 - DNA, 17 bp, Homo sapiens
gtggattgtggcagcag

SEQ ID NO: 9171 - DNA, 17 bp, Homo sapiens
tggattgtggcagcagc

SEQ ID NO: 9172 - DNA, 17 bp, Homo sapiens
ggattgtggcagcagcg

SEQ ID NO: 9173 - DNA, 17 bp, Homo sapiens
gattgtggcagcagcgg

SEQ ID NO: 9174 - DNA, 17 bp, Homo sapiens
attgtggcagcagcggc

SEQ ID NO: 9175 - DNA, 17 bp, Homo sapiens
ttgtggcagcagcggcc

SEQ ID NO: 9176 - DNA, 17 bp, Homo sapiens
tgtggcagcagcggccg

SEQ ID NO: 9177 - DNA, 17 bp, Homo sapiens
gtggcagcagcggccga

SEQ ID NO: 9178 - DNA, 17 bp, Homo sapiens
tggcagcagcggccgaa

SEQ ID NO: 9179 - DNA, 17 bp, Homo sapiens
ggcagcagcggccgaaa

SEQ ID NO: 9180 - DNA, 17 bp, Homo sapiens
gcagcagcggccgaaaa

SEQ ID NO: 9181 - DNA, 17 bp, Homo sapiens
cagcagcggccgaaaag

SEQ ID NO: 9182 - DNA, 17 bp, Homo sapiens
agcagcggccgaaaaga

SEQ ID NO: 9183 - DNA, 17 bp, Homo sapiens
gcagcggccgaaaagag

SEQ ID NO: 9184 - DNA, 17 bp, Homo sapiens
cagcggccgaaaagaga

SEQ ID NO: 9185 - DNA, 17 bp, Homo sapiens
agcggccgaaaagagat

SEQ ID NO: 9186 - DNA, 17 bp, Homo sapiens
gcggccgaaaagagatg

SEQ ID NO: 9187 - DNA, 17 bp, Homo sapiens
cggccgaaaagagatgg

SEQ ID NO: 9188 - DNA, 17 bp, Homo sapiens
ggccgaaaagagatgga

SEQ ID NO: 9189 - DNA, 17 bp, Homo sapiens
gccgaaaagagatggat

SEQ ID NO: 9190 - DNA, 17 bp, Homo sapiens
ccgaaaagagatggata

SEQ ID NO: 9191 - DNA, 17 bp, Homo sapiens
cgaaaagagatggataa

SEQ ID NO: 9192 - DNA, 17 bp, Homo sapiens
gaaaagagatggataac

SEQ ID NO: 9193 - DNA, 17 bp, Homo sapiens
aaaagagatggataacg

SEQ ID NO: 9194 - DNA, 17 bp, Homo sapiens
aaagagatggataacgt

SEQ ID NO: 9195 - DNA, 17 bp, Homo sapiens
aagagatggataacgtc

SEQ ID NO: 9196 - DNA, 17 bp, Homo sapiens
agagatggataacgtct

SEQ ID NO: 9197 - DNA, 17 bp, Homo sapiens
gagatggataacgtctc

SEQ ID NO: 9198 - DNA, 17 bp, Homo sapiens
agatggataacgtctcc

SEQ ID NO: 9199 - DNA, 17 bp, Homo sapiens
gatggataacgtctcca

SEQ ID NO: 9200 - DNA, 17 bp, Homo sapiens
atggataacgtctccat

SEQ ID NO: 9201 - DNA, 17 bp, Homo sapiens
tggataacgtctccatc

SEQ ID NO: 9202 - DNA, 17 bp, Homo sapiens
ggataacgtctccatcc

SEQ ID NO: 9203 - DNA, 17 bp, Homo sapiens
gataacgtctccatcct

SEQ ID NO: 9204 - DNA, 17 bp, Homo sapiens
ataacgtctccatcctc

SEQ ID NO: 9205 - DNA, 17 bp, Homo sapiens
taacgtctccatcctca

SEQ ID NO: 9206 - DNA, 17 bp, Homo sapiens
aacgtctccatcctcag

SEQ ID NO: 9207 - DNA, 17 bp, Homo sapiens
acgtctccatcctcagc

SEQ ID NO: 9208 - DNA, 17 bp, Homo sapiens
cgtctccatcctcagct

SEQ ID NO: 9209 - DNA, 17 bp, Homo sapiens
gtctccatcctcagctc

SEQ ID NO: 9210 - DNA, 17 bp, Homo sapiens
tctccatcctcagctcc

SEQ ID NO: 9211 - DNA, 17 bp, Homo sapiens
ctccatcctcagctccc

SEQ ID NO: 9212 - DNA, 17 bp, Homo sapiens
tccatcctcagctccca

SEQ ID NO: 9213 - DNA, 17 bp, Homo sapiens
ccatcctcagctcccag

SEQ ID NO: 9214 - DNA, 17 bp, Homo sapiens
catcctcagctcccagc

SEQ ID NO: 9215 - DNA, 17 bp, Homo sapiens
atcctcagctcccagcc

SEQ ID NO: 9216 - DNA, 17 bp, Homo sapiens
tcctcagctcccagcca

SEQ ID NO: 9217 - DNA, 17 bp, Homo sapiens
cctcagctcccagccag

SEQ ID NO: 9218 - DNA, 17 bp, Homo sapiens
ctcagctcccagccaga

SEQ ID NO: 9219 - DNA, 17 bp, Homo sapiens
tcagctcccagccagag

SEQ ID NO: 9220 - DNA, 17 bp, Homo sapiens
cagctcccagccagagg

SEQ ID NO: 9221 - DNA, 17 bp, Homo sapiens
agctcccagccagaggg

SEQ ID NO: 9222 - DNA, 17 bp, Homo sapiens
gctcccagccagagggc

SEQ ID NO: 9223 - DNA, 17 bp, Homo sapiens
ctcccagccagagggca

SEQ ID NO: 9224 - DNA, 17 bp, Homo sapiens
tcccagccagagggcag

SEQ ID NO: 9225 - DNA, 17 bp, Homo sapiens
cccagccagagggcagc

SEQ ID NO: 9226 - DNA, 17 bp, Homo sapiens
ccagccagagggcagcc

SEQ ID NO: 9227 - DNA, 17 bp, Homo sapiens
cagccagagggcagcct

SEQ ID NO: 9228 - DNA, 17 bp, Homo sapiens
agccagagggcagcctg

SEQ ID NO: 9229 - DNA, 17 bp, Homo sapiens
gccagagggcagcctgc

SEQ ID NO: 9230 - DNA, 17 bp, Homo sapiens
ccagagggcagcctgca

SEQ ID NO: 9231 - DNA, 17 bp, Homo sapiens
cagagggcagcctgcag

SEQ ID NO: 9232 - DNA, 17 bp, Homo sapiens
agagggcagcctgcagt

SEQ ID NO: 9233 - DNA, 17 bp, Homo sapiens
gagggcagcctgcagtc

SEQ ID NO: 9234 - DNA, 17 bp, Homo sapiens
agggcagcctgcagtcc

SEQ ID NO: 9235 - DNA, 17 bp, Homo sapiens
gggcagcctgcagtcct

SEQ ID NO: 9236 - DNA, 17 bp, Homo sapiens
ggcagcctgcagtcctg

SEQ ID NO: 9237 - DNA, 17 bp, Homo sapiens
gcagcctgcagtcctgg

SEQ ID NO: 9238 - DNA, 17 bp, Homo sapiens
cagcctgcagtcctggt

SEQ ID NO: 9239 - DNA, 17 bp, Homo sapiens
agcctgcagtcctggtt

SEQ ID NO: 9240 - DNA, 17 bp, Homo sapiens
gcctgcagtcctggttg

SEQ ID NO: 9241 - DNA, 17 bp, Homo sapiens
cctgcagtcctggttga

SEQ ID NO: 9242 - DNA, 17 bp, Homo sapiens
ctgcagtcctggttgag

SEQ ID NO: 9243 - DNA, 17 bp, Homo sapiens
tgcagtcctggttgagc

SEQ ID NO: 9244 - DNA, 17 bp, Homo sapiens
gcagtcctggttgagct

SEQ ID NO: 9245 - DNA, 17 bp, Homo sapiens
cagtcctggttgagctg

SEQ ID NO: 9246 - DNA, 17 bp, Homo sapiens
agtcctggttgagctgt

SEQ ID NO: 9247 - DNA, 17 bp, Homo sapiens
gtcctggttgagctgta

SEQ ID NO: 9248 - DNA, 17 bp, Homo sapiens
tcctggttgagctgtac

SEQ ID NO: 9249 - DNA, 17 bp, Homo sapiens
cctggttgagctgtact

SEQ ID NO: 9250 - DNA, 17 bp, Homo sapiens
ctggttgagctgtactc

SEQ ID NO: 9251 - DNA, 17 bp, Homo sapiens
tggttgagctgtactct

SEQ ID NO: 9252 - DNA, 17 bp, Homo sapiens
ggttgagctgtactctg

SEQ ID NO: 9253 - DNA, 17 bp, Homo sapiens
gttgagctgtactctgt

SEQ ID NO: 9254 - DNA, 17 bp, Homo sapiens
ttgagctgtactctgtc

SEQ ID NO: 9255 - DNA, 17 bp, Homo sapiens
tgagctgtactctgtcc

SEQ ID NO: 9256 - DNA, 17 bp, Homo sapiens
gagctgtactctgtccc

SEQ ID NO: 9257 - DNA, 17 bp, Homo sapiens
agctgtactctgtccct

SEQ ID NO: 9258 - DNA, 17 bp, Homo sapiens
gctgtactctgtccctg

SEQ ID NO: 9259 - DNA, 17 bp, Homo sapiens
ctgtactctgtccctgg

SEQ ID NO: 9260 - DNA, 17 bp, Homo sapiens
tgtactctgtccctggc

SEQ ID NO: 9261 - DNA, 17 bp, Homo sapiens
gtactctgtccctggcc

SEQ ID NO: 9262 - DNA, 17 bp, Homo sapiens
tactctgtccctggcca

SEQ ID NO: 9263 - DNA, 17 bp, Homo sapiens
actctgtccctggccac

SEQ ID NO: 9264 - DNA, 17 bp, Homo sapiens
ctctgtccctggccaca

SEQ ID NO: 9265 - DNA, 17 bp, Homo sapiens
tctgtccctggccacag

SEQ ID NO: 9266 - DNA, 17 bp, Homo sapiens
ctgtccctggccacaga

SEQ ID NO: 9267 - DNA, 17 bp, Homo sapiens
tgtccctggccacagat

SEQ ID NO: 9268 - DNA, 17 bp, Homo sapiens
gtccctggccacagata

SEQ ID NO: 9269 - DNA, 17 bp, Homo sapiens
tccctggccacagatac

SEQ ID NO: 9270 - DNA, 17 bp, Homo sapiens
ccctggccacagatact

SEQ ID NO: 9271 - DNA, 17 bp, Homo sapiens
cctggccacagatacta

SEQ ID NO: 9272 - DNA, 17 bp, Homo sapiens
ctggccacagatactat

SEQ ID NO: 9273 - DNA, 17 bp, Homo sapiens
tggccacagatactatg

SEQ ID NO: 9274 - DNA, 17 bp, Homo sapiens
ggccacagatactatga

SEQ ID NO: 9275 - DNA, 17 bp, Homo sapiens
gccacagatactatgag

SEQ ID NO: 9276 - DNA, 17 bp, Homo sapiens
ccacagatactatgagg

SEQ ID NO: 9277 - DNA, 17 bp, Homo sapiens
cacagatactatgagga

SEQ ID NO: 9278 - DNA, 17 bp, Homo sapiens
acagatactatgaggac

SEQ ID NO: 9279 - DNA, 17 bp, Homo sapiens
cagatactatgaggact

SEQ ID NO: 9280 - DNA, 17 bp, Homo sapiens
agatactatgaggactc

SEQ ID NO: 9281 - DNA, 17 bp, Homo sapiens
gatactatgaggactcc

SEQ ID NO: 9282 - DNA, 17 bp, Homo sapiens
atactatgaggactcct

SEQ ID NO: 9283 - DNA, 17 bp, Homo sapiens
tactatgaggactcctt

SEQ ID NO: 9284 - DNA, 17 bp, Homo sapiens
actatgaggactccttc

SEQ ID NO: 9285 - DNA, 17 bp, Homo sapiens
ctatgaggactccttct

SEQ ID NO: 9286 - DNA, 17 bp, Homo sapiens
tatgaggactccttctc

SEQ ID NO: 9287 - DNA, 17 bp, Homo sapiens
atgaggactccttctcg

SEQ ID NO: 9288 - DNA, 17 bp, Homo sapiens
tgaggactccttctcga

SEQ ID NO: 9289 - DNA, 17 bp, Homo sapiens
gaggactccttctcgac

SEQ ID NO: 9290 - DNA, 17 bp, Homo sapiens
aggactccttctcgaca

SEQ ID NO: 9291 - DNA, 17 bp, Homo sapiens
ggactccttctcgacag

SEQ ID NO: 9292 - DNA, 17 bp, Homo sapiens
gactccttctcgacagt

SEQ ID NO: 9293 - DNA, 17 bp, Homo sapiens
actccttctcgacagtc

SEQ ID NO: 9294 - DNA, 17 bp, Homo sapiens
ctccttctcgacagtca

SEQ ID NO: 9295 - DNA, 17 bp, Homo sapiens
tccttctcgacagtcag

SEQ ID NO: 9296 - DNA, 17 bp, Homo sapiens
ccttctcgacagtcagc

SEQ ID NO: 9297 - DNA, 17 bp, Homo sapiens
cttctcgacagtcagcc

SEQ ID NO: 9298 - DNA, 17 bp, Homo sapiens
ttctcgacagtcagcca

SEQ ID NO: 9299 - DNA, 17 bp, Homo sapiens
tctcgacagtcagccac

SEQ ID NO: 9300 - DNA, 17 bp, Homo sapiens
ctcgacagtcagccacc

SEQ ID NO: 9301 - DNA, 17 bp, Homo sapiens
tcgacagtcagccacca

SEQ ID NO: 9302 - DNA, 17 bp, Homo sapiens
cgacagtcagccaccag

SEQ ID NO: 9303 - DNA, 17 bp, Homo sapiens
gacagtcagccaccagc

SEQ ID NO: 9304 - DNA, 17 bp, Homo sapiens
acagtcagccaccagca

SEQ ID NO: 9305 - DNA, 17 bp, Homo sapiens
cagtcagccaccagcag

SEQ ID NO: 9306 - DNA, 17 bp, Homo sapiens
agtcagccaccagcagc

SEQ ID NO: 9307 - DNA, 17 bp, Homo sapiens
gtcagccaccagcagcc

SEQ ID NO: 9308 - DNA, 17 bp, Homo sapiens
tcagccaccagcagccg

SEQ ID NO: 9309 - DNA, 17 bp, Homo sapiens
cagccaccagcagccgc

SEQ ID NO: 9310 - DNA, 17 bp, Homo sapiens
agccaccagcagccgca

SEQ ID NO: 9311 - DNA, 17 bp, Homo sapiens
gccaccagcagccgcat

SEQ ID NO: 9312 - DNA, 17 bp, Homo sapiens
ccaccagcagccgcatc

SEQ ID NO: 9313 - DNA, 17 bp, Homo sapiens
caccagcagccgcatcc

SEQ ID NO: 9314 - DNA, 17 bp, Homo sapiens
accagcagccgcatcct

SEQ ID NO: 9315 - DNA, 17 bp, Homo sapiens
ccagcagccgcatcctc

SEQ ID NO: 9316 - DNA, 17 bp, Homo sapiens
cagcagccgcatcctca

SEQ ID NO: 9317 - DNA, 17 bp, Homo sapiens
agcagccgcatcctcag

SEQ ID NO: 9318 - DNA, 17 bp, Homo sapiens
gcagccgcatcctcagc

SEQ ID NO: 9319 - DNA, 17 bp, Homo sapiens
cagccgcatcctcagcc

SEQ ID NO: 9320 - DNA, 17 bp, Homo sapiens
agccgcatcctcagccc

SEQ ID NO: 9321 - DNA, 17 bp, Homo sapiens
gccgcatcctcagcccc

SEQ ID NO: 9322 - DNA, 17 bp, Homo sapiens
ccgcatcctcagcccca

SEQ ID NO: 9323 - DNA, 17 bp, Homo sapiens
cgcatcctcagccccag

SEQ ID NO: 9324 - DNA, 17 bp, Homo sapiens
gcatcctcagccccagg

SEQ ID NO: 9325 - DNA, 17 bp, Homo sapiens
catcctcagccccagga

SEQ ID NO: 9326 - DNA, 17 bp, Homo sapiens
atcctcagccccaggat

SEQ ID NO: 9327 - DNA, 17 bp, Homo sapiens
tcctcagccccaggata

SEQ ID NO: 9328 - DNA, 17 bp, Homo sapiens
cctcagccccaggataa

SEQ ID NO: 9329 - DNA, 17 bp, Homo sapiens
ctcagccccaggataaa

SEQ ID NO: 9330 - DNA, 17 bp, Homo sapiens
tcagccccaggataaac

SEQ ID NO: 9331 - DNA, 17 bp, Homo sapiens
cagccccaggataaacg

SEQ ID NO: 9332 - DNA, 17 bp, Homo sapiens
agccccaggataaacga

SEQ ID NO: 9333 - DNA, 17 bp, Homo sapiens
gccccaggataaacgaa

SEQ ID NO: 9334 - DNA, 17 bp, Homo sapiens
ccccaggataaacgaag

SEQ ID NO: 9335 - DNA, 17 bp, Homo sapiens
cccaggataaacgaaga

SEQ ID NO: 9336 - DNA, 17 bp, Homo sapiens
ccaggataaacgaagag

SEQ ID NO: 9337 - DNA, 17 bp, Homo sapiens
caggataaacgaagagg

SEQ ID NO: 9338 - DNA, 17 bp, Homo sapiens
aggataaacgaagaggc

SEQ ID NO: 9339 - DNA, 17 bp, Homo sapiens
ggataaacgaagaggct

SEQ ID NO: 9340 - DNA, 17 bp, Homo sapiens
gataaacgaagaggctg

SEQ ID NO: 9341 - DNA, 17 bp, Homo sapiens
ataaacgaagaggctgg

SEQ ID NO: 9342 - DNA, 17 bp, Homo sapiens
taaacgaagaggctggg

SEQ ID NO: 9343 - DNA, 17 bp, Homo sapiens
aaacgaagaggctgggg

SEQ ID NO: 9344 - DNA, 17 bp, Homo sapiens
aacgaagaggctgggga

SEQ ID NO: 9345 - DNA, 17 bp, Homo sapiens
acgaagaggctggggac

SEQ ID NO: 9346 - DNA, 17 bp, Homo sapiens
cgaagaggctggggaca

SEQ ID NO: 9347 - DNA, 17 bp, Homo sapiens
gaagaggctggggacac

SEQ ID NO: 9348 - DNA, 17 bp, Homo sapiens
aagaggctggggacact

SEQ ID NO: 9349 - DNA, 17 bp, Homo sapiens
agaggctggggacactg

SEQ ID NO: 9350 - DNA, 17 bp, Homo sapiens
gaggctggggacactga

SEQ ID NO: 9351 - DNA, 17 bp, Homo sapiens
aggctggggacactgag

SEQ ID NO: 9352 - DNA, 17 bp, Homo sapiens
ggctggggacactgaga

SEQ ID NO: 9353 - DNA, 17 bp, Homo sapiens
gctggggacactgagag

SEQ ID NO: 9354 - DNA, 17 bp, Homo sapiens
ctggggacactgagagg

SEQ ID NO: 9355 - DNA, 17 bp, Homo sapiens
tggggacactgagagga

SEQ ID NO: 9356 - DNA, 17 bp, Homo sapiens
ggggacactgagaggac

SEQ ID NO: 9357 - DNA, 17 bp, Homo sapiens
gggacactgagaggacc

SEQ ID NO: 9358 - DNA, 17 bp, Homo sapiens
ggacactgagaggaccc

SEQ ID NO: 9359 - DNA, 17 bp, Homo sapiens
gacactgagaggaccca

SEQ ID NO: 9360 - DNA, 17 bp, Homo sapiens
acactgagaggacccag

SEQ ID NO: 9361 - DNA, 17 bp, Homo sapiens
cactgagaggacccagt

SEQ ID NO: 9362 - DNA, 17 bp, Homo sapiens
actgagaggacccagtc

SEQ ID NO: 9363 - DNA, 17 bp, Homo sapiens
ctgagaggacccagtcg

SEQ ID NO: 9364 - DNA, 17 bp, Homo sapiens
tgagaggacccagtcgg

SEQ ID NO: 9365 - DNA, 17 bp, Homo sapiens
gagaggacccagtcggc

SEQ ID NO: 9366 - DNA, 17 bp, Homo sapiens
agaggacccagtcggca

SEQ ID NO: 9367 - DNA, 17 bp, Homo sapiens
gaggacccagtcggcat

SEQ ID NO: 9368 - DNA, 17 bp, Homo sapiens
aggacccagtcggcatt

SEQ ID NO: 9369 - DNA, 17 bp, Homo sapiens
ggacccagtcggcattg

SEQ ID NO: 9370 - DNA, 17 bp, Homo sapiens
gacccagtcggcattgg

SEQ ID NO: 9371 - DNA, 17 bp, Homo sapiens
acccagtcggcattggc

SEQ ID NO: 9372 - DNA, 17 bp, Homo sapiens
cccagtcggcattggca

SEQ ID NO: 9373 - DNA, 17 bp, Homo sapiens
ccagtcggcattggcac

SEQ ID NO: 9374 - DNA, 17 bp, Homo sapiens
cagtcggcattggcact

SEQ ID NO: 9375 - DNA, 17 bp, Homo sapiens
agtcggcattggcactg

SEQ ID NO: 9376 - DNA, 17 bp, Homo sapiens
gtcggcattggcactga

SEQ ID NO: 9377 - DNA, 17 bp, Homo sapiens
tcggcattggcactgag

SEQ ID NO: 9378 - DNA, 17 bp, Homo sapiens
cggcattggcactgagc

SEQ ID NO: 9379 - DNA, 17 bp, Homo sapiens
ggcattggcactgagca

SEQ ID NO: 9380 - DNA, 17 bp, Homo sapiens
gcattggcactgagcag

SEQ ID NO: 9381 - DNA, 17 bp, Homo sapiens
cattggcactgagcaga

SEQ ID NO: 9382 - DNA, 17 bp, Homo sapiens
attggcactgagcagag

SEQ ID NO: 9383 - DNA, 17 bp, Homo sapiens
ttggcactgagcagagc

SEQ ID NO: 9384 - DNA, 17 bp, Homo sapiens
tggcactgagcagagcc

SEQ ID NO: 9385 - DNA, 17 bp, Homo sapiens
ggcactgagcagagccc

SEQ ID NO: 9386 - DNA, 17 bp, Homo sapiens
gcactgagcagagcccg

SEQ ID NO: 9387 - DNA, 17 bp, Homo sapiens
cactgagcagagcccgg

SEQ ID NO: 9388 - DNA, 17 bp, Homo sapiens
actgagcagagcccggt

SEQ ID NO: 9389 - DNA, 17 bp, Homo sapiens
ctgagcagagcccggtc

SEQ ID NO: 9390 - DNA, 17 bp, Homo sapiens
tgagcagagcccggtcc

SEQ ID NO: 9391 - DNA, 17 bp, Homo sapiens
gagcagagcccggtcca

SEQ ID NO: 9392 - DNA, 17 bp, Homo sapiens
agcagagcccggtccac

SEQ ID NO: 9393 - DNA, 17 bp, Homo sapiens
gcagagcccggtccacc

SEQ ID NO: 9394 - DNA, 17 bp, Homo sapiens
cagagcccggtccacca

SEQ ID NO: 9395 - DNA, 17 bp, Homo sapiens
agagcccggtccaccaa

SEQ ID NO: 9396 - DNA, 17 bp, Homo sapiens
gagcccggtccaccaat

SEQ ID NO: 9397 - DNA, 17 bp, Homo sapiens
agcccggtccaccaatg

SEQ ID NO: 9398 - DNA, 17 bp, Homo sapiens
gcccggtccaccaatgt

SEQ ID NO: 9399 - DNA, 17 bp, Homo sapiens
cccggtccaccaatgtc

SEQ ID NO: 9400 - DNA, 17 bp, Homo sapiens
ccggtccaccaatgtcc

SEQ ID NO: 9401 - DNA, 17 bp, Homo sapiens
cggtccaccaatgtcca

SEQ ID NO: 9402 - DNA, 17 bp, Homo sapiens
ggtccaccaatgtccac

SEQ ID NO: 9403 - DNA, 17 bp, Homo sapiens
gtccaccaatgtccaca

SEQ ID NO: 9404 - DNA, 17 bp, Homo sapiens
tccaccaatgtccacag

SEQ ID NO: 9405 - DNA, 17 bp, Homo sapiens
ccaccaatgtccacagc

SEQ ID NO: 9406 - DNA, 17 bp, Homo sapiens
caccaatgtccacagca

SEQ ID NO: 9407 - DNA, 17 bp, Homo sapiens
accaatgtccacagcaa

SEQ ID NO: 9408 - DNA, 17 bp, Homo sapiens
ccaatgtccacagcaag

SEQ ID NO: 9409 - DNA, 17 bp, Homo sapiens
caatgtccacagcaaga

SEQ ID NO: 9410 - DNA, 17 bp, Homo sapiens
aatgtccacagcaagac

SEQ ID NO: 9411 - DNA, 17 bp, Homo sapiens
atgtccacagcaagacc

SEQ ID NO: 9412 - DNA, 17 bp, Homo sapiens
tgtccacagcaagacct

SEQ ID NO: 9413 - DNA, 17 bp, Homo sapiens
gtccacagcaagacctc

SEQ ID NO: 9414 - DNA, 17 bp, Homo sapiens
tccacagcaagacctca

SEQ ID NO: 9415 - DNA, 17 bp, Homo sapiens
ccacagcaagacctcag

SEQ ID NO: 9416 - DNA, 17 bp, Homo sapiens
cacagcaagacctcagg

SEQ ID NO: 9417 - DNA, 17 bp, Homo sapiens
acagcaagacctcagga

SEQ ID NO: 9418 - DNA, 17 bp, Homo sapiens
cagcaagacctcaggag

SEQ ID NO: 9419 - DNA, 17 bp, Homo sapiens
agcaagacctcaggaga

SEQ ID NO: 9420 - DNA, 17 bp, Homo sapiens
gcaagacctcaggagac

SEQ ID NO: 9421 - DNA, 17 bp, Homo sapiens
caagacctcaggagaca

SEQ ID NO: 9422 - DNA, 17 bp, Homo sapiens
aagacctcaggagacaa

SEQ ID NO: 9423 - DNA, 17 bp, Homo sapiens
agacctcaggagacaag

SEQ ID NO: 9424 - DNA, 17 bp, Homo sapiens
gacctcaggagacaagc

SEQ ID NO: 9425 - DNA, 17 bp, Homo sapiens
acctcaggagacaagcc

SEQ ID NO: 9426 - DNA, 17 bp, Homo sapiens
cctcaggagacaagcct

SEQ ID NO: 9427 - DNA, 17 bp, Homo sapiens
ctcaggagacaagcctg

SEQ ID NO: 9428 - DNA, 17 bp, Homo sapiens
tcaggagacaagcctgt

SEQ ID NO: 9429 - DNA, 17 bp, Homo sapiens
caggagacaagcctgtt

SEQ ID NO: 9430 - DNA, 17 bp, Homo sapiens
aggagacaagcctgttt

SEQ ID NO: 9431 - DNA, 17 bp, Homo sapiens
ggagacaagcctgtttc

SEQ ID NO: 9432 - DNA, 17 bp, Homo sapiens
gagacaagcctgtttct

SEQ ID NO: 9433 - DNA, 17 bp, Homo sapiens
agacaagcctgtttctc

SEQ ID NO: 9434 - DNA, 17 bp, Homo sapiens
gacaagcctgtttctcc

SEQ ID NO: 9435 - DNA, 17 bp, Homo sapiens
acaagcctgtttctccc

SEQ ID NO: 9436 - DNA, 17 bp, Homo sapiens
caagcctgtttctcccc

SEQ ID NO: 9437 - DNA, 17 bp, Homo sapiens
aagcctgtttctcccca

SEQ ID NO: 9438 - DNA, 17 bp, Homo sapiens
agcctgtttctccccac

SEQ ID NO: 9439 - DNA, 17 bp, Homo sapiens
gcctgtttctccccact

SEQ ID NO: 9440 - DNA, 17 bp, Homo sapiens
cctgtttctccccactt

SEQ ID NO: 9441 - DNA, 17 bp, Homo sapiens
ctgtttctccccacttt

SEQ ID NO: 9442 - DNA, 17 bp, Homo sapiens
tgtttctccccactttg

SEQ ID NO: 9443 - DNA, 17 bp, Homo sapiens
gtttctccccactttgt

SEQ ID NO: 9444 - DNA, 17 bp, Homo sapiens
tttctccccactttgtc

SEQ ID NO: 9445 - DNA, 17 bp, Homo sapiens
ttctccccactttgtcc

SEQ ID NO: 9446 - DNA, 17 bp, Homo sapiens
tctccccactttgtccg

SEQ ID NO: 9447 - DNA, 17 bp, Homo sapiens
ctccccactttgtccgc

SEQ ID NO: 9448 - DNA, 17 bp, Homo sapiens
tccccactttgtccgcc

SEQ ID NO: 9449 - DNA, 17 bp, Homo sapiens
ccccactttgtccgccg

SEQ ID NO: 9450 - DNA, 17 bp, Homo sapiens
cccactttgtccgccgg

SEQ ID NO: 9451 - DNA, 17 bp, Homo sapiens
ccactttgtccgccggc

SEQ ID NO: 9452 - DNA, 17 bp, Homo sapiens
cactttgtccgccggca

SEQ ID NO: 9453 - DNA, 17 bp, Homo sapiens
actttgtccgccggcaa

SEQ ID NO: 9454 - DNA, 17 bp, Homo sapiens
ctttgtccgccggcaaa

SEQ ID NO: 9455 - DNA, 17 bp, Homo sapiens
tttgtccgccggcaaaa

SEQ ID NO: 9456 - DNA, 17 bp, Homo sapiens
ttgtccgccggcaaaag

SEQ ID NO: 9457 - DNA, 17 bp, Homo sapiens
tgtccgccggcaaaagt

SEQ ID NO: 9458 - DNA, 17 bp, Homo sapiens
gtccgccggcaaaagta

SEQ ID NO: 9459 - DNA, 17 bp, Homo sapiens
tccgccggcaaaagtac

SEQ ID NO: 9460 - DNA, 17 bp, Homo sapiens
ccgccggcaaaagtact

SEQ ID NO: 9461 - DNA, 17 bp, Homo sapiens
cgccggcaaaagtactg

SEQ ID NO: 9462 - DNA, 17 bp, Homo sapiens
gccggcaaaagtactgt

SEQ ID NO: 9463 - DNA, 17 bp, Homo sapiens
ccggcaaaagtactgtc

SEQ ID NO: 9464 - DNA, 17 bp, Homo sapiens
cggcaaaagtactgtca

SEQ ID NO: 9465 - DNA, 17 bp, Homo sapiens
ggcaaaagtactgtcat

SEQ ID NO: 9466 - DNA, 17 bp, Homo sapiens
gcaaaagtactgtcatt

SEQ ID NO: 9467 - DNA, 17 bp, Homo sapiens
caaaagtactgtcattt

SEQ ID NO: 9468 - DNA, 17 bp, Homo sapiens
aaaagtactgtcatttt

SEQ ID NO: 9469 - DNA, 17 bp, Homo sapiens
aaagtactgtcattttg

SEQ ID NO: 9470 - DNA, 17 bp, Homo sapiens
aagtactgtcattttgg

SEQ ID NO: 9471 - DNA, 17 bp, Homo sapiens
agtactgtcattttggg

SEQ ID NO: 9472 - DNA, 17 bp, Homo sapiens
gtactgtcattttgggg

SEQ ID NO: 9473 - DNA, 17 bp, Homo sapiens
tactgtcattttgggga

SEQ ID NO: 9474 - DNA, 17 bp, Homo sapiens
actgtcattttggggac

SEQ ID NO: 9475 - DNA, 17 bp, Homo sapiens
ctgtcattttggggacg

SEQ ID NO: 9476 - DNA, 17 bp, Homo sapiens
tgtcattttggggacgg

SEQ ID NO: 9477 - DNA, 17 bp, Homo sapiens
gtcattttggggacggc

SEQ ID NO: 9478 - DNA, 17 bp, Homo sapiens
tcattttggggacggcg

SEQ ID NO: 9479 - DNA, 17 bp, Homo sapiens
cattttggggacggcga

SEQ ID NO: 9480 - DNA, 17 bp, Homo sapiens
attttggggacggcgaa

SEQ ID NO: 9481 - DNA, 17 bp, Homo sapiens
ttttggggacggcgaag

SEQ ID NO: 9482 - DNA, 17 bp, Homo sapiens
tttggggacggcgaagt

SEQ ID NO: 9483 - DNA, 17 bp, Homo sapiens
ttggggacggcgaagtg

SEQ ID NO: 9484 - DNA, 17 bp, Homo sapiens
tggggacggcgaagtgc

SEQ ID NO: 9485 - DNA, 17 bp, Homo sapiens
ggggacggcgaagtgct

SEQ ID NO: 9486 - DNA, 17 bp, Homo sapiens
gggacggcgaagtgctt

SEQ ID NO: 9487 - DNA, 17 bp, Homo sapiens
ggacggcgaagtgcttg

SEQ ID NO: 9488 - DNA, 17 bp, Homo sapiens
gacggcgaagtgcttgc

SEQ ID NO: 9489 - DNA, 17 bp, Homo sapiens
acggcgaagtgcttgcc

SEQ ID NO: 9490 - DNA, 17 bp, Homo sapiens
cggcgaagtgcttgccg

SEQ ID NO: 9491 - DNA, 17 bp, Homo sapiens
ggcgaagtgcttgccgt

SEQ ID NO: 9492 - DNA, 17 bp, Homo sapiens
gcgaagtgcttgccgtc

SEQ ID NO: 9493 - DNA, 17 bp, Homo sapiens
cgaagtgcttgccgtcc

SEQ ID NO: 9494 - DNA, 17 bp, Homo sapiens
gaagtgcttgccgtcca

SEQ ID NO: 9495 - DNA, 17 bp, Homo sapiens
aagtgcttgccgtccag

SEQ ID NO: 9496 - DNA, 17 bp, Homo sapiens
agtgcttgccgtccaga

SEQ ID NO: 9497 - DNA, 17 bp, Homo sapiens
gtgcttgccgtccagag

SEQ ID NO: 9498 - DNA, 17 bp, Homo sapiens
tgcttgccgtccagaga

SEQ ID NO: 9499 - DNA, 17 bp, Homo sapiens
gcttgccgtccagagaa

SEQ ID NO: 9500 - DNA, 17 bp, Homo sapiens
cttgccgtccagagaaa

SEQ ID NO: 9501 - DNA, 17 bp, Homo sapiens
ttgccgtccagagaaag

SEQ ID NO: 9502 - DNA, 17 bp, Homo sapiens
tgccgtccagagaaagt

SEQ ID NO: 9503 - DNA, 17 bp, Homo sapiens
gccgtccagagaaagtc

SEQ ID NO: 9504 - DNA, 17 bp, Homo sapiens
ccgtccagagaaagtcc

SEQ ID NO: 9505 - DNA, 17 bp, Homo sapiens
cgtccagagaaagtcca

SEQ ID NO: 9506 - DNA, 17 bp, Homo sapiens
gtccagagaaagtccac

SEQ ID NO: 9507 - DNA, 17 bp, Homo sapiens
tccagagaaagtccaca

SEQ ID NO: 9508 - DNA, 17 bp, Homo sapiens
ccagagaaagtccacag

SEQ ID NO: 9509 - DNA, 17 bp, Homo sapiens
cagagaaagtccacaga

SEQ ID NO: 9510 - DNA, 17 bp, Homo sapiens
agagaaagtccacagag

SEQ ID NO: 9511 - DNA, 17 bp, Homo sapiens
gagaaagtccacagaga

SEQ ID NO: 9512 - DNA, 17 bp, Homo sapiens
agaaagtccacagagag

SEQ ID NO: 9513 - DNA, 17 bp, Homo sapiens
gaaagtccacagagaga

SEQ ID NO: 9514 - DNA, 17 bp, Homo sapiens
aaagtccacagagagat

SEQ ID NO: 9515 - DNA, 17 bp, Homo sapiens
aagtccacagagagatt

SEQ ID NO: 9516 - DNA, 17 bp, Homo sapiens
agtccacagagagatta

SEQ ID NO: 9517 - DNA, 17 bp, Homo sapiens
gtccacagagagattag

SEQ ID NO: 9518 - DNA, 17 bp, Homo sapiens
tccacagagagattaga

SEQ ID NO: 9519 - DNA, 17 bp, Homo sapiens
ccacagagagattagaa

SEQ ID NO: 9520 - DNA, 17 bp, Homo sapiens
cacagagagattagaac

SEQ ID NO: 9521 - DNA, 17 bp, Homo sapiens
acagagagattagaacc

SEQ ID NO: 9522 - DNA, 17 bp, Homo sapiens
cagagagattagaacct

SEQ ID NO: 9523 - DNA, 17 bp, Homo sapiens
agagagattagaacctg

SEQ ID NO: 9524 - DNA, 17 bp, Homo sapiens
gagagattagaacctgc

SEQ ID NO: 9525 - DNA, 17 bp, Homo sapiens
agagattagaacctgct

SEQ ID NO: 9526 - DNA, 17 bp, Homo sapiens
gagattagaacctgctt

SEQ ID NO: 9527 - DNA, 17 bp, Homo sapiens
agattagaacctgcttc

SEQ ID NO: 9528 - DNA, 17 bp, Homo sapiens
gattagaacctgcttcc

SEQ ID NO: 9529 - DNA, 17 bp, Homo sapiens
attagaacctgcttcct

SEQ ID NO: 9530 - DNA, 17 bp, Homo sapiens
ttagaacctgcttcctc

SEQ ID NO: 9531 - DNA, 17 bp, Homo sapiens
tagaacctgcttcctct

SEQ ID NO: 9532 - DNA, 17 bp, Homo sapiens
agaacctgcttcctctc

SEQ ID NO: 9533 - DNA, 17 bp, Homo sapiens
gaacctgcttcctctcc

SEQ ID NO: 9534 - DNA, 17 bp, Homo sapiens
aacctgcttcctctccc

SEQ ID NO: 9535 - DNA, 17 bp, Homo sapiens
acctgcttcctctcccc

SEQ ID NO: 9536 - DNA, 17 bp, Homo sapiens
cctgcttcctctcccct

SEQ ID NO: 9537 - DNA, 17 bp, Homo sapiens
ctgcttcctctcccctg

SEQ ID NO: 9538 - DNA, 17 bp, Homo sapiens
tgcttcctctcccctgg

SEQ ID NO: 9539 - DNA, 17 bp, Homo sapiens
gcttcctctcccctggc

SEQ ID NO: 9540 - DNA, 17 bp, Homo sapiens
cttcctctcccctggct

SEQ ID NO: 9541 - DNA, 17 bp, Homo sapiens
ttcctctcccctggctt

SEQ ID NO: 9542 - DNA, 17 bp, Homo sapiens
tcctctcccctggcttc

SEQ ID NO: 9543 - DNA, 17 bp, Homo sapiens
cctctcccctggcttct

SEQ ID NO: 9544 - DNA, 17 bp, Homo sapiens
ctctcccctggcttctc

SEQ ID NO: 9545 - DNA, 17 bp, Homo sapiens
tctcccctggcttctcg

SEQ ID NO: 9546 - DNA, 17 bp, Homo sapiens
ctcccctggcttctcgg

SEQ ID NO: 9547 - DNA, 17 bp, Homo sapiens
tcccctggcttctcgga

SEQ ID NO: 9548 - DNA, 17 bp, Homo sapiens
cccctggcttctcggag

SEQ ID NO: 9549 - DNA, 17 bp, Homo sapiens
ccctggcttctcggagt

SEQ ID NO: 9550 - DNA, 17 bp, Homo sapiens
cctggcttctcggagta

SEQ ID NO: 9551 - DNA, 17 bp, Homo sapiens
ctggcttctcggagtac

SEQ ID NO: 9552 - DNA, 17 bp, Homo sapiens
tggcttctcggagtaca

SEQ ID NO: 9553 - DNA, 17 bp, Homo sapiens
ggcttctcggagtacaa

SEQ ID NO: 9554 - DNA, 17 bp, Homo sapiens
gcttctcggagtacaaa

SEQ ID NO: 9555 - DNA, 17 bp, Homo sapiens
cttctcggagtacaaat

SEQ ID NO: 9556 - DNA, 17 bp, Homo sapiens
ttctcggagtacaaata

SEQ ID NO: 9557 - DNA, 17 bp, Homo sapiens
tctcggagtacaaatac

SEQ ID NO: 9558 - DNA, 17 bp, Homo sapiens
ctcggagtacaaataca

SEQ ID NO: 9559 - DNA, 17 bp, Homo sapiens
tcggagtacaaatacat

SEQ ID NO: 9560 - DNA, 17 bp, Homo sapiens
cggagtacaaatacatc

SEQ ID NO: 9561 - DNA, 17 bp, Homo sapiens
ggagtacaaatacatcc

SEQ ID NO: 9562 - DNA, 17 bp, Homo sapiens
gagtacaaatacatccc

SEQ ID NO: 9563 - DNA, 17 bp, Homo sapiens
agtacaaatacatcccc

SEQ ID NO: 9564 - DNA, 17 bp, Homo sapiens
gtacaaatacatccccg

SEQ ID NO: 9565 - DNA, 17 bp, Homo sapiens
tacaaatacatccccgc

SEQ ID NO: 9566 - DNA, 17 bp, Homo sapiens
acaaatacatccccgct

SEQ ID NO: 9567 - DNA, 17 bp, Homo sapiens
caaatacatccccgctg

SEQ ID NO: 9568 - DNA, 17 bp, Homo sapiens
aaatacatccccgctgt

SEQ ID NO: 9569 - DNA, 17 bp, Homo sapiens
aatacatccccgctgtc

SEQ ID NO: 9570 - DNA, 17 bp, Homo sapiens
atacatccccgctgtcg

SEQ ID NO: 9571 - DNA, 17 bp, Homo sapiens
tacatccccgctgtcga

SEQ ID NO: 9572 - DNA, 17 bp, Homo sapiens
acatccccgctgtcgag

SEQ ID NO: 9573 - DNA, 17 bp, Homo sapiens
catccccgctgtcgagg

SEQ ID NO: 9574 - DNA, 17 bp, Homo sapiens
atccccgctgtcgaggg

SEQ ID NO: 9575 - DNA, 17 bp, Homo sapiens
tccccgctgtcgaggga

SEQ ID NO: 9576 - DNA, 17 bp, Homo sapiens
ccccgctgtcgagggaa

SEQ ID NO: 9577 - DNA, 17 bp, Homo sapiens
cccgctgtcgagggaaa

SEQ ID NO: 9578 - DNA, 17 bp, Homo sapiens
ccgctgtcgagggaaaa

SEQ ID NO: 9579 - DNA, 17 bp, Homo sapiens
cgctgtcgagggaaaag

SEQ ID NO: 9580 - DNA, 17 bp, Homo sapiens
gctgtcgagggaaaagc

SEQ ID NO: 9581 - DNA, 17 bp, Homo sapiens
ctgtcgagggaaaagct

SEQ ID NO: 9582 - DNA, 17 bp, Homo sapiens
tgtcgagggaaaagctg

SEQ ID NO: 9583 - DNA, 17 bp, Homo sapiens
gtcgagggaaaagctgc

SEQ ID NO: 9584 - DNA, 17 bp, Homo sapiens
tcgagggaaaagctgcc

SEQ ID NO: 9585 - DNA, 17 bp, Homo sapiens
cgagggaaaagctgccc

SEQ ID NO: 9586 - DNA, 17 bp, Homo sapiens
gagggaaaagctgccca

SEQ ID NO: 9587 - DNA, 17 bp, Homo sapiens
agggaaaagctgcccag

SEQ ID NO: 9588 - DNA, 17 bp, Homo sapiens
gggaaaagctgcccagt

SEQ ID NO: 9589 - DNA, 17 bp, Homo sapiens
ggaaaagctgcccagtc

SEQ ID NO: 9590 - DNA, 17 bp, Homo sapiens
gaaaagctgcccagtcc

SEQ ID NO: 9591 - DNA, 17 bp, Homo sapiens
aaaagctgcccagtcct

SEQ ID NO: 9592 - DNA, 17 bp, Homo sapiens
aaagctgcccagtcctt

SEQ ID NO: 9593 - DNA, 17 bp, Homo sapiens
aagctgcccagtccttc

SEQ ID NO: 9594 - DNA, 17 bp, Homo sapiens
agctgcccagtccttca

SEQ ID NO: 9595 - DNA, 17 bp, Homo sapiens
gctgcccagtccttcag

SEQ ID NO: 9596 - DNA, 17 bp, Homo sapiens
ctgcccagtccttcagc

SEQ ID NO: 9597 - DNA, 17 bp, Homo sapiens
tgcccagtccttcagcg

SEQ ID NO: 9598 - DNA, 17 bp, Homo sapiens
gcccagtccttcagcgg

SEQ ID NO: 9599 - DNA, 17 bp, Homo sapiens
cccagtccttcagcggc

SEQ ID NO: 9600 - DNA, 17 bp, Homo sapiens
ccagtccttcagcggcc

SEQ ID NO: 9601 - DNA, 17 bp, Homo sapiens
cagtccttcagcggccc

SEQ ID NO: 9602 - DNA, 17 bp, Homo sapiens
agtccttcagcggccct

SEQ ID NO: 9603 - DNA, 17 bp, Homo sapiens
gtccttcagcggccctc

SEQ ID NO: 9604 - DNA, 17 bp, Homo sapiens
tccttcagcggccctct

SEQ ID NO: 9605 - DNA, 17 bp, Homo sapiens
ccttcagcggccctctc

SEQ ID NO: 9606 - DNA, 17 bp, Homo sapiens
cttcagcggccctctcg

SEQ ID NO: 9607 - DNA, 17 bp, Homo sapiens
ttcagcggccctctcgg

SEQ ID NO: 9608 - DNA, 17 bp, Homo sapiens
tcagcggccctctcgga

SEQ ID NO: 9609 - DNA, 17 bp, Homo sapiens
cagcggccctctcggag

SEQ ID NO: 9610 - DNA, 17 bp, Homo sapiens
agcggccctctcggagt

SEQ ID NO: 9611 - DNA, 17 bp, Homo sapiens
gcggccctctcggagtt

SEQ ID NO: 9612 - DNA, 17 bp, Homo sapiens
cggccctctcggagttc

SEQ ID NO: 9613 - DNA, 17 bp, Homo sapiens
ggccctctcggagttcg

SEQ ID NO: 9614 - DNA, 17 bp, Homo sapiens
gccctctcggagttcgt

SEQ ID NO: 9615 - DNA, 17 bp, Homo sapiens
ccctctcggagttcgtg

SEQ ID NO: 9616 - DNA, 17 bp, Homo sapiens
cctctcggagttcgtgg

SEQ ID NO: 9617 - DNA, 17 bp, Homo sapiens
ctctcggagttcgtgga

SEQ ID NO: 9618 - DNA, 17 bp, Homo sapiens
tctcggagttcgtggaa

SEQ ID NO: 9619 - DNA, 17 bp, Homo sapiens
ctcggagttcgtggaag

SEQ ID NO: 9620 - DNA, 17 bp, Homo sapiens
tcggagttcgtggaagg

SEQ ID NO: 9621 - DNA, 17 bp, Homo sapiens
cggagttcgtggaaggg

SEQ ID NO: 9622 - DNA, 17 bp, Homo sapiens
ggagttcgtggaagggc

SEQ ID NO: 9623 - DNA, 17 bp, Homo sapiens
gagttcgtggaagggct

SEQ ID NO: 9624 - DNA, 17 bp, Homo sapiens
agttcgtggaagggctc

SEQ ID NO: 9625 - DNA, 17 bp, Homo sapiens
gttcgtggaagggctcc

SEQ ID NO: 9626 - DNA, 17 bp, Homo sapiens
ttcgtggaagggctccg

SEQ ID NO: 9627 - DNA, 17 bp, Homo sapiens
tcgtggaagggctccgg

SEQ ID NO: 9628 - DNA, 17 bp, Homo sapiens
cgtggaagggctccgga

SEQ ID NO: 9629 - DNA, 17 bp, Homo sapiens
gtggaagggctccggag

SEQ ID NO: 9630 - DNA, 17 bp, Homo sapiens
tggaagggctccggagg

SEQ ID NO: 9631 - DNA, 17 bp, Homo sapiens
ggaagggctccggagga

SEQ ID NO: 9632 - DNA, 17 bp, Homo sapiens
gaagggctccggaggaa

SEQ ID NO: 9633 - DNA, 17 bp, Homo sapiens
aagggctccggaggaag

SEQ ID NO: 9634 - DNA, 17 bp, Homo sapiens
agggctccggaggaaga

SEQ ID NO: 9635 - DNA, 17 bp, Homo sapiens
gggctccggaggaagag

SEQ ID NO: 9636 - DNA, 17 bp, Homo sapiens
ggctccggaggaagaga

SEQ ID NO: 9637 - DNA, 17 bp, Homo sapiens
gctccggaggaagagag

SEQ ID NO: 9638 - DNA, 17 bp, Homo sapiens
ctccggaggaagagagc

SEQ ID NO: 9639 - DNA, 17 bp, Homo sapiens
tccggaggaagagagcc

SEQ ID NO: 9640 - DNA, 17 bp, Homo sapiens
ccggaggaagagagccc

SEQ ID NO: 9641 - DNA, 17 bp, Homo sapiens
cggaggaagagagccca

SEQ ID NO: 9642 - DNA, 17 bp, Homo sapiens
ggaggaagagagcccag

SEQ ID NO: 9643 - DNA, 17 bp, Homo sapiens
gaggaagagagcccaga

SEQ ID NO: 9644 - DNA, 17 bp, Homo sapiens
aggaagagagcccagag

SEQ ID NO: 9645 - DNA, 17 bp, Homo sapiens
ggaagagagcccagaga

SEQ ID NO: 9646 - DNA, 17 bp, Homo sapiens
gaagagagcccagagag

SEQ ID NO: 9647 - DNA, 17 bp, Homo sapiens
aagagagcccagagagg

SEQ ID NO: 9648 - DNA, 17 bp, Homo sapiens
agagagcccagagaggc

SEQ ID NO: 9649 - DNA, 17 bp, Homo sapiens
gagagcccagagaggcc

SEQ ID NO: 9650 - DNA, 17 bp, Homo sapiens
agagcccagagaggcca

SEQ ID NO: 9651 - DNA, 17 bp, Homo sapiens
gagcccagagaggccag

SEQ ID NO: 9652 - DNA, 17 bp, Homo sapiens
agcccagagaggccagg

SEQ ID NO: 9653 - DNA, 17 bp, Homo sapiens
gcccagagaggccaggg

SEQ ID NO: 9654 - DNA, 17 bp, Homo sapiens
cccagagaggccagggg

SEQ ID NO: 9655 - DNA, 17 bp, Homo sapiens
ccagagaggccaggggt

SEQ ID NO: 9656 - DNA, 17 bp, Homo sapiens
cagagaggccaggggtc

SEQ ID NO: 9657 - DNA, 17 bp, Homo sapiens
agagaggccaggggtcc

SEQ ID NO: 9658 - DNA, 17 bp, Homo sapiens
gagaggccaggggtcca

SEQ ID NO: 9659 - DNA, 17 bp, Homo sapiens
agaggccaggggtccac

SEQ ID NO: 9660 - DNA, 17 bp, Homo sapiens
gaggccaggggtccacg

SEQ ID NO: 9661 - DNA, 17 bp, Homo sapiens
aggccaggggtccacgc

SEQ ID NO: 9662 - DNA, 17 bp, Homo sapiens
ggccaggggtccacgct

SEQ ID NO: 9663 - DNA, 17 bp, Homo sapiens
gccaggggtccacgctg

SEQ ID NO: 9664 - DNA, 17 bp, Homo sapiens
ccaggggtccacgctgg

SEQ ID NO: 9665 - DNA, 17 bp, Homo sapiens
caggggtccacgctggg

SEQ ID NO: 9666 - DNA, 17 bp, Homo sapiens
aggggtccacgctgggc

SEQ ID NO: 9667 - DNA, 17 bp, Homo sapiens
ggggtccacgctgggcc

SEQ ID NO: 9668 - DNA, 17 bp, Homo sapiens
gggtccacgctgggcct

SEQ ID NO: 9669 - DNA, 17 bp, Homo sapiens
ggtccacgctgggccta

SEQ ID NO: 9670 - DNA, 17 bp, Homo sapiens
gtccacgctgggcctag

SEQ ID NO: 9671 - DNA, 17 bp, Homo sapiens
tccacgctgggcctaga

SEQ ID NO: 9672 - DNA, 17 bp, Homo sapiens
ccacgctgggcctagag

SEQ ID NO: 9673 - DNA, 17 bp, Homo sapiens
cacgctgggcctagagg

SEQ ID NO: 9674 - DNA, 17 bp, Homo sapiens
acgctgggcctagagga

SEQ ID NO: 9675 - DNA, 17 bp, Homo sapiens
cgctgggcctagaggac

SEQ ID NO: 9676 - DNA, 17 bp, Homo sapiens
gctgggcctagaggact

SEQ ID NO: 9677 - DNA, 17 bp, Homo sapiens
ctgggcctagaggactg

SEQ ID NO: 9678 - DNA, 17 bp, Homo sapiens
tgggcctagaggactgg

SEQ ID NO: 9679 - DNA, 17 bp, Homo sapiens
gggcctagaggactggc

SEQ ID NO: 9680 - DNA, 17 bp, Homo sapiens
ggcctagaggactggcc

SEQ ID NO: 9681 - DNA, 17 bp, Homo sapiens
gcctagaggactggccc

SEQ ID NO: 9682 - DNA, 17 bp, Homo sapiens
cctagaggactggccca

SEQ ID NO: 9683 - DNA, 17 bp, Homo sapiens
ctagaggactggcccac

SEQ ID NO: 9684 - DNA, 17 bp, Homo sapiens
tagaggactggcccact

SEQ ID NO: 9685 - DNA, 17 bp, Homo sapiens
agaggactggcccactc

SEQ ID NO: 9686 - DNA, 17 bp, Homo sapiens
gaggactggcccactct

SEQ ID NO: 9687 - DNA, 17 bp, Homo sapiens
aggactggcccactctc

SEQ ID NO: 9688 - DNA, 17 bp, Homo sapiens
ggactggcccactctcc

SEQ ID NO: 9689 - DNA, 17 bp, Homo sapiens
gactggcccactctccc

SEQ ID NO: 9690 - DNA, 17 bp, Homo sapiens
actggcccactctcccc

SEQ ID NO: 9691 - DNA, 17 bp, Homo sapiens
ctggcccactctcccca

SEQ ID NO: 9692 - DNA, 17 bp, Homo sapiens
tggcccactctccccat

SEQ ID NO: 9693 - DNA, 17 bp, Homo sapiens
ggcccactctccccatt

SEQ ID NO: 9694 - DNA, 17 bp, Homo sapiens
gcccactctccccattt

SEQ ID NO: 9695 - DNA, 17 bp, Homo sapiens
cccactctccccattta

SEQ ID NO: 9696 - DNA, 17 bp, Homo sapiens
ccactctccccatttac

SEQ ID NO: 9697 - DNA, 17 bp, Homo sapiens
cactctccccatttacc

SEQ ID NO: 9698 - DNA, 17 bp, Homo sapiens
actctccccatttacca

SEQ ID NO: 9699 - DNA, 17 bp, Homo sapiens
ctctccccatttaccag

SEQ ID NO: 9700 - DNA, 17 bp, Homo sapiens
tctccccatttaccaga

SEQ ID NO: 9701 - DNA, 17 bp, Homo sapiens
ctccccatttaccagac

SEQ ID NO: 9702 - DNA, 17 bp, Homo sapiens
tccccatttaccagacg

SEQ ID NO: 9703 - DNA, 17 bp, Homo sapiens
ccccatttaccagacga

SEQ ID NO: 9704 - DNA, 17 bp, Homo sapiens
cccatttaccagacgac

SEQ ID NO: 9705 - DNA, 17 bp, Homo sapiens
ccatttaccagacgact

SEQ ID NO: 9706 - DNA, 17 bp, Homo sapiens
catttaccagacgactg

SEQ ID NO: 9707 - DNA, 17 bp, Homo sapiens
atttaccagacgactgg

SEQ ID NO: 9708 - DNA, 17 bp, Homo sapiens
tttaccagacgactggg

SEQ ID NO: 9709 - DNA, 17 bp, Homo sapiens
ttaccagacgactgggg

SEQ ID NO: 9710 - DNA, 17 bp, Homo sapiens
taccagacgactggggc

SEQ ID NO: 9711 - DNA, 17 bp, Homo sapiens
accagacgactggggcc

SEQ ID NO: 9712 - DNA, 17 bp, Homo sapiens
ccagacgactggggcct

SEQ ID NO: 9713 - DNA, 17 bp, Homo sapiens
cagacgactggggcctc

SEQ ID NO: 9714 - DNA, 17 bp, Homo sapiens
agacgactggggcctcc

SEQ ID NO: 9715 - DNA, 17 bp, Homo sapiens
gacgactggggcctcca

SEQ ID NO: 9716 - DNA, 17 bp, Homo sapiens
acgactggggcctccac

SEQ ID NO: 9717 - DNA, 17 bp, Homo sapiens
cgactggggcctccaca

SEQ ID NO: 9718 - DNA, 17 bp, Homo sapiens
gactggggcctccacac

SEQ ID NO: 9719 - DNA, 17 bp, Homo sapiens
actggggcctccacact

SEQ ID NO: 9720 - DNA, 17 bp, Homo sapiens
ctggggcctccacacta

SEQ ID NO: 9721 - DNA, 17 bp, Homo sapiens
tggggcctccacactaa

SEQ ID NO: 9722 - DNA, 17 bp, Homo sapiens
ggggcctccacactaag

SEQ ID NO: 9723 - DNA, 17 bp, Homo sapiens
gggcctccacactaagg

SEQ ID NO: 9724 - DNA, 17 bp, Homo sapiens
ggcctccacactaagga

SEQ ID NO: 9725 - DNA, 17 bp, Homo sapiens
gcctccacactaaggag

SEQ ID NO: 9726 - DNA, 17 bp, Homo sapiens
cctccacactaaggagg

SEQ ID NO: 9727 - DNA, 17 bp, Homo sapiens
ctccacactaaggaggg

SEQ ID NO: 9728 - DNA, 17 bp, Homo sapiens
tccacactaaggagggg

SEQ ID NO: 9729 - DNA, 17 bp, Homo sapiens
ccacactaaggaggggc

SEQ ID NO: 9730 - DNA, 17 bp, Homo sapiens
cacactaaggaggggca

SEQ ID NO: 9731 - DNA, 17 bp, Homo sapiens
acactaaggaggggcag

SEQ ID NO: 9732 - DNA, 17 bp, Homo sapiens
cactaaggaggggcagg

SEQ ID NO: 9733 - DNA, 17 bp, Homo sapiens
actaaggaggggcaggg

SEQ ID NO: 9734 - DNA, 17 bp, Homo sapiens
ctaaggaggggcagggc

SEQ ID NO: 9735 - DNA, 17 bp, Homo sapiens
taaggaggggcagggct

SEQ ID NO: 9736 - DNA, 17 bp, Homo sapiens
aaggaggggcagggctg

SEQ ID NO: 9737 - DNA, 17 bp, Homo sapiens
aggaggggcagggctgg

SEQ ID NO: 9738 - DNA, 17 bp, Homo sapiens
ggaggggcagggctggc

SEQ ID NO: 9739 - DNA, 17 bp, Homo sapiens
gaggggcagggctggca

SEQ ID NO: 9740 - DNA, 17 bp, Homo sapiens
aggggcagggctggcag

SEQ ID NO: 9741 - DNA, 17 bp, Homo sapiens
ggggcagggctggcagt

SEQ ID NO: 9742 - DNA, 17 bp, Homo sapiens
gggcagggctggcagtg

SEQ ID NO: 9743 - DNA, 17 bp, Homo sapiens
ggcagggctggcagtga

SEQ ID NO: 9744 - DNA, 17 bp, Homo sapiens
gcagggctggcagtgac

SEQ ID NO: 9745 - DNA, 17 bp, Homo sapiens
cagggctggcagtgacg

SEQ ID NO: 9746 - DNA, 17 bp, Homo sapiens
agggctggcagtgacga

SEQ ID NO: 9747 - DNA, 17 bp, Homo sapiens
gggctggcagtgacgag

SEQ ID NO: 9748 - DNA, 17 bp, Homo sapiens
ggctggcagtgacgagg

SEQ ID NO: 9749 - DNA, 17 bp, Homo sapiens
gctggcagtgacgaggg

SEQ ID NO: 9750 - DNA, 17 bp, Homo sapiens
ctggcagtgacgaggga

SEQ ID NO: 9751 - DNA, 17 bp, Homo sapiens
tggcagtgacgagggaa

SEQ ID NO: 9752 - DNA, 17 bp, Homo sapiens
ggcagtgacgagggaaa

SEQ ID NO: 9753 - DNA, 17 bp, Homo sapiens
gcagtgacgagggaaac

SEQ ID NO: 9754 - DNA, 17 bp, Homo sapiens
cagtgacgagggaaacc

SEQ ID NO: 9755 - DNA, 17 bp, Homo sapiens
agtgacgagggaaacct

SEQ ID NO: 9756 - DNA, 17 bp, Homo sapiens
gtgacgagggaaacctc

SEQ ID NO: 9757 - DNA, 17 bp, Homo sapiens
tgacgagggaaacctct

SEQ ID NO: 9758 - DNA, 17 bp, Homo sapiens
gacgagggaaacctctc

SEQ ID NO: 9759 - DNA, 17 bp, Homo sapiens
acgagggaaacctctcg

SEQ ID NO: 9760 - DNA, 17 bp, Homo sapiens
cgagggaaacctctcgc

SEQ ID NO: 9761 - DNA, 17 bp, Homo sapiens
gagggaaacctctcgct

SEQ ID NO: 9762 - DNA, 17 bp, Homo sapiens
agggaaacctctcgctg

SEQ ID NO: 9763 - DNA, 17 bp, Homo sapiens
gggaaacctctcgctga

SEQ ID NO: 9764 - DNA, 17 bp, Homo sapiens
ggaaacctctcgctgag

SEQ ID NO: 9765 - DNA, 17 bp, Homo sapiens
gaaacctctcgctgagg

SEQ ID NO: 9766 - DNA, 17 bp, Homo sapiens
aaacctctcgctgaggg

SEQ ID NO: 9767 - DNA, 17 bp, Homo sapiens
aacctctcgctgagggt

SEQ ID NO: 9768 - DNA, 17 bp, Homo sapiens
acctctcgctgagggtt

SEQ ID NO: 9769 - DNA, 17 bp, Homo sapiens
cctctcgctgagggttg

SEQ ID NO: 9770 - DNA, 17 bp, Homo sapiens
ctctcgctgagggttgg

SEQ ID NO: 9771 - DNA, 17 bp, Homo sapiens
tctcgctgagggttggg

SEQ ID NO: 9772 - DNA, 17 bp, Homo sapiens
ctcgctgagggttgggg

SEQ ID NO: 9773 - DNA, 17 bp, Homo sapiens
tcgctgagggttggggc

SEQ ID NO: 9774 - DNA, 17 bp, Homo sapiens
cgctgagggttggggca

SEQ ID NO: 9775 - DNA, 17 bp, Homo sapiens
gctgagggttggggcaa

SEQ ID NO: 9776 - DNA, 17 bp, Homo sapiens
ctgagggttggggcaaa

SEQ ID NO: 9777 - DNA, 17 bp, Homo sapiens
tgagggttggggcaaag

SEQ ID NO: 9778 - DNA, 17 bp, Homo sapiens
gagggttggggcaaagt

SEQ ID NO: 9779 - DNA, 17 bp, Homo sapiens
agggttggggcaaagtc

SEQ ID NO: 9780 - DNA, 17 bp, Homo sapiens
gggttggggcaaagtca

SEQ ID NO: 9781 - DNA, 17 bp, Homo sapiens
ggttggggcaaagtcac

SEQ ID NO: 9782 - DNA, 17 bp, Homo sapiens
gttggggcaaagtcacc

SEQ ID NO: 9783 - DNA, 17 bp, Homo sapiens
ttggggcaaagtcaccc

SEQ ID NO: 9784 - DNA, 17 bp, Homo sapiens
tggggcaaagtcacccc

SEQ ID NO: 9785 - DNA, 17 bp, Homo sapiens
ggggcaaagtcacccct

SEQ ID NO: 9786 - DNA, 17 bp, Homo sapiens
gggcaaagtcacccctg

SEQ ID NO: 9787 - DNA, 17 bp, Homo sapiens
ggcaaagtcacccctgg

SEQ ID NO: 9788 - DNA, 17 bp, Homo sapiens
gcaaagtcacccctgga

SEQ ID NO: 9789 - DNA, 17 bp, Homo sapiens
caaagtcacccctggaa

SEQ ID NO: 9790 - DNA, 17 bp, Homo sapiens
aaagtcacccctggaaa

SEQ ID NO: 9791 - DNA, 17 bp, Homo sapiens
aagtcacccctggaaat

SEQ ID NO: 9792 - DNA, 17 bp, Homo sapiens
agtcacccctggaaatc

SEQ ID NO: 9793 - DNA, 17 bp, Homo sapiens
gtcacccctggaaatcg

SEQ ID NO: 9794 - DNA, 17 bp, Homo sapiens
tcacccctggaaatcga

SEQ ID NO: 9795 - DNA, 17 bp, Homo sapiens
cacccctggaaatcgaa

SEQ ID NO: 9796 - DNA, 17 bp, Homo sapiens
acccctggaaatcgaag

SEQ ID NO: 9797 - DNA, 17 bp, Homo sapiens
cccctggaaatcgaagg

SEQ ID NO: 9798 - DNA, 17 bp, Homo sapiens
ccctggaaatcgaaggg

SEQ ID NO: 9799 - DNA, 17 bp, Homo sapiens
cctggaaatcgaagggg

SEQ ID NO: 9800 - DNA, 17 bp, Homo sapiens
ctggaaatcgaaggggc

SEQ ID NO: 9801 - DNA, 17 bp, Homo sapiens
tggaaatcgaaggggcc

SEQ ID NO: 9802 - DNA, 17 bp, Homo sapiens
ggaaatcgaaggggccg

SEQ ID NO: 9803 - DNA, 17 bp, Homo sapiens
gaaatcgaaggggccgc

SEQ ID NO: 9804 - DNA, 17 bp, Homo sapiens
aaatcgaaggggccgct

SEQ ID NO: 9805 - DNA, 17 bp, Homo sapiens
aatcgaaggggccgctg

SEQ ID NO: 9806 - DNA, 17 bp, Homo sapiens
atcgaaggggccgctgg

SEQ ID NO: 9807 - DNA, 17 bp, Homo sapiens
tcgaaggggccgctggt

SEQ ID NO: 9808 - DNA, 17 bp, Homo sapiens
cgaaggggccgctggtg

SEQ ID NO: 9809 - DNA, 17 bp, Homo sapiens
gaaggggccgctggtgg

SEQ ID NO: 9810 - DNA, 17 bp, Homo sapiens
aaggggccgctggtggt

SEQ ID NO: 9811 - DNA, 17 bp, Homo sapiens
aggggccgctggtggtc

SEQ ID NO: 9812 - DNA, 17 bp, Homo sapiens
ggggccgctggtggtct

SEQ ID NO: 9813 - DNA, 17 bp, Homo sapiens
gggccgctggtggtctc

SEQ ID NO: 9814 - DNA, 17 bp, Homo sapiens
ggccgctggtggtctct

SEQ ID NO: 9815 - DNA, 17 bp, Homo sapiens
gccgctggtggtctctt

SEQ ID NO: 9816 - DNA, 17 bp, Homo sapiens
ccgctggtggtctcttg

SEQ ID NO: 9817 - DNA, 17 bp, Homo sapiens
cgctggtggtctcttga

SEQ ID NO: 9818 - DNA, 17 bp, Homo sapiens
gctggtggtctcttgag

SEQ ID NO: 9819 - DNA, 17 bp, Homo sapiens
ctggtggtctcttgagg

SEQ ID NO: 9820 - DNA, 17 bp, Homo sapiens
tggtggtctcttgaggt

SEQ ID NO: 9821 - DNA, 17 bp, Homo sapiens
ggtggtctcttgaggtc

SEQ ID NO: 9822 - DNA, 17 bp, Homo sapiens
gtggtctcttgaggtcc

SEQ ID NO: 9823 - DNA, 17 bp, Homo sapiens
tggtctcttgaggtcca

SEQ ID NO: 9824 - DNA, 17 bp, Homo sapiens
ggtctcttgaggtccac

SEQ ID NO: 9825 - DNA, 17 bp, Homo sapiens
gtctcttgaggtccacc

SEQ ID NO: 9826 - DNA, 17 bp, Homo sapiens
tctcttgaggtccacca

SEQ ID NO: 9827 - DNA, 17 bp, Homo sapiens
ctcttgaggtccaccag

SEQ ID NO: 9828 - DNA, 17 bp, Homo sapiens
tcttgaggtccaccagc

SEQ ID NO: 9829 - DNA, 17 bp, Homo sapiens
cttgaggtccaccagcc

SEQ ID NO: 9830 - DNA, 17 bp, Homo sapiens
ttgaggtccaccagcct

SEQ ID NO: 9831 - DNA, 17 bp, Homo sapiens
tgaggtccaccagcctc

SEQ ID NO: 9832 - DNA, 17 bp, Homo sapiens
gaggtccaccagcctca

SEQ ID NO: 9833 - DNA, 17 bp, Homo sapiens
aggtccaccagcctcaa

SEQ ID NO: 9834 - DNA, 17 bp, Homo sapiens
ggtccaccagcctcaaa

SEQ ID NO: 9835 - DNA, 17 bp, Homo sapiens
gtccaccagcctcaaat

SEQ ID NO: 9836 - DNA, 17 bp, Homo sapiens
tccaccagcctcaaatg

SEQ ID NO: 9837 - DNA, 17 bp, Homo sapiens
ccaccagcctcaaatgc

SEQ ID NO: 9838 - DNA, 17 bp, Homo sapiens
caccagcctcaaatgca

SEQ ID NO: 9839 - DNA, 17 bp, Homo sapiens
accagcctcaaatgcat

SEQ ID NO: 9840 - DNA, 17 bp, Homo sapiens
ccagcctcaaatgcatc

SEQ ID NO: 9841 - DNA, 17 bp, Homo sapiens
cagcctcaaatgcatct

SEQ ID NO: 9842 - DNA, 17 bp, Homo sapiens
agcctcaaatgcatctc

SEQ ID NO: 9843 - DNA, 17 bp, Homo sapiens
gcctcaaatgcatctct

SEQ ID NO: 9844 - DNA, 17 bp, Homo sapiens
cctcaaatgcatctctt

SEQ ID NO: 9845 - DNA, 17 bp, Homo sapiens
ctcaaatgcatctcttc

SEQ ID NO: 9846 - DNA, 17 bp, Homo sapiens
tcaaatgcatctcttca

SEQ ID NO: 9847 - DNA, 17 bp, Homo sapiens
caaatgcatctcttcag

SEQ ID NO: 9848 - DNA, 17 bp, Homo sapiens
aaatgcatctcttcaga

SEQ ID NO: 9849 - DNA, 17 bp, Homo sapiens
aatgcatctcttcagac

SEQ ID NO: 9850 - DNA, 17 bp, Homo sapiens
atgcatctcttcagacg

SEQ ID NO: 9851 - DNA, 17 bp, Homo sapiens
tgcatctcttcagacgg

SEQ ID NO: 9852 - DNA, 17 bp, Homo sapiens
gcatctcttcagacggt

SEQ ID NO: 9853 - DNA, 17 bp, Homo sapiens
catctcttcagacggtg

SEQ ID NO: 9854 - DNA, 17 bp, Homo sapiens
atctcttcagacggtgt

SEQ ID NO: 9855 - DNA, 17 bp, Homo sapiens
tctcttcagacggtgtt

SEQ ID NO: 9856 - DNA, 17 bp, Homo sapiens
ctcttcagacggtgttg

SEQ ID NO: 9857 - DNA, 17 bp, Homo sapiens
tcttcagacggtgttgg

SEQ ID NO: 9858 - DNA, 17 bp, Homo sapiens
cttcagacggtgttggg

SEQ ID NO: 9859 - DNA, 17 bp, Homo sapiens
ttcagacggtgttgggg

SEQ ID NO: 9860 - DNA, 17 bp, Homo sapiens
tcagacggtgttggggg

SEQ ID NO: 9861 - DNA, 17 bp, Homo sapiens
cagacggtgttgggggc

SEQ ID NO: 9862 - DNA, 17 bp, Homo sapiens
agacggtgttgggggca

SEQ ID NO: 9863 - DNA, 17 bp, Homo sapiens
gacggtgttgggggcac

SEQ ID NO: 9864 - DNA, 17 bp, Homo sapiens
acggtgttgggggcaca

SEQ ID NO: 9865 - DNA, 17 bp, Homo sapiens
cggtgttgggggcacaa

SEQ ID NO: 9866 - DNA, 17 bp, Homo sapiens
ggtgttgggggcacaac

SEQ ID NO: 9867 - DNA, 17 bp, Homo sapiens
gtgttgggggcacaacc

SEQ ID NO: 9868 - DNA, 17 bp, Homo sapiens
tgttgggggcacaaccc

SEQ ID NO: 9869 - DNA, 17 bp, Homo sapiens
gttgggggcacaaccct

SEQ ID NO: 9870 - DNA, 17 bp, Homo sapiens
ttgggggcacaacccta

SEQ ID NO: 9871 - DNA, 17 bp, Homo sapiens
tgggggcacaaccctac

SEQ ID NO: 9872 - DNA, 17 bp, Homo sapiens
gggggcacaaccctact

SEQ ID NO: 9873 - DNA, 17 bp, Homo sapiens
ggggcacaaccctactc

SEQ ID NO: 9874 - DNA, 17 bp, Homo sapiens
gggcacaaccctactcc

SEQ ID NO: 9875 - DNA, 17 bp, Homo sapiens
ggcacaaccctactccc

SEQ ID NO: 9876 - DNA, 17 bp, Homo sapiens
gcacaaccctactcccc

SEQ ID NO: 9877 - DNA, 17 bp, Homo sapiens
cacaaccctactccccg

SEQ ID NO: 9878 - DNA, 17 bp, Homo sapiens
acaaccctactccccga

SEQ ID NO: 9879 - DNA, 17 bp, Homo sapiens
caaccctactccccgaa

SEQ ID NO: 9880 - DNA, 17 bp, Homo sapiens
aaccctactccccgaaa

SEQ ID NO: 9881 - DNA, 17 bp, Homo sapiens
accctactccccgaaaa

SEQ ID NO: 9882 - DNA, 17 bp, Homo sapiens
ccctactccccgaaaag

SEQ ID NO: 9883 - DNA, 17 bp, Homo sapiens
cctactccccgaaaagt

SEQ ID NO: 9884 - DNA, 17 bp, Homo sapiens
ctactccccgaaaagtc

SEQ ID NO: 9885 - DNA, 17 bp, Homo sapiens
tactccccgaaaagtcg

SEQ ID NO: 9886 - DNA, 17 bp, Homo sapiens
actccccgaaaagtcga

SEQ ID NO: 9887 - DNA, 17 bp, Homo sapiens
ctccccgaaaagtcgaa

SEQ ID NO: 9888 - DNA, 17 bp, Homo sapiens
tccccgaaaagtcgaaa

SEQ ID NO: 9889 - DNA, 17 bp, Homo sapiens
ccccgaaaagtcgaaaa

SEQ ID NO: 9890 - DNA, 17 bp, Homo sapiens
cccgaaaagtcgaaaac

SEQ ID NO: 9891 - DNA, 17 bp, Homo sapiens
ccgaaaagtcgaaaacc

SEQ ID NO: 9892 - DNA, 17 bp, Homo sapiens
cgaaaagtcgaaaaccc

SEQ ID NO: 9893 - DNA, 17 bp, Homo sapiens
gaaaagtcgaaaaccca

SEQ ID NO: 9894 - DNA, 17 bp, Homo sapiens
aaaagtcgaaaacccaa

SEQ ID NO: 9895 - DNA, 17 bp, Homo sapiens
aaagtcgaaaacccaat

SEQ ID NO: 9896 - DNA, 17 bp, Homo sapiens
aagtcgaaaacccaatt

SEQ ID NO: 9897 - DNA, 17 bp, Homo sapiens
agtcgaaaacccaattc

SEQ ID NO: 9898 - DNA, 17 bp, Homo sapiens
gtcgaaaacccaattca

SEQ ID NO: 9899 - DNA, 17 bp, Homo sapiens
tcgaaaacccaattcag

SEQ ID NO: 9900 - DNA, 17 bp, Homo sapiens
cgaaaacccaattcagt

SEQ ID NO: 9901 - DNA, 17 bp, Homo sapiens
gaaaacccaattcagtt

SEQ ID NO: 9902 - DNA, 17 bp, Homo sapiens
aaaacccaattcagttc

SEQ ID NO: 9903 - DNA, 17 bp, Homo sapiens
aaacccaattcagttcc

SEQ ID NO: 9904 - DNA, 17 bp, Homo sapiens
aacccaattcagttcct

SEQ ID NO: 9905 - DNA, 17 bp, Homo sapiens
acccaattcagttcctg

SEQ ID NO: 9906 - DNA, 17 bp, Homo sapiens
cccaattcagttcctgc

SEQ ID NO: 9907 - DNA, 17 bp, Homo sapiens
ccaattcagttcctgcg

SEQ ID NO: 9908 - DNA, 17 bp, Homo sapiens
caattcagttcctgcga

SEQ ID NO: 9909 - DNA, 17 bp, Homo sapiens
aattcagttcctgcgag

SEQ ID NO: 9910 - DNA, 17 bp, Homo sapiens
attcagttcctgcgagt

SEQ ID NO: 9911 - DNA, 17 bp, Homo sapiens
ttcagttcctgcgagtc

SEQ ID NO: 9912 - DNA, 17 bp, Homo sapiens
tcagttcctgcgagtcc

SEQ ID NO: 9913 - DNA, 17 bp, Homo sapiens
cagttcctgcgagtccc

SEQ ID NO: 9914 - DNA, 17 bp, Homo sapiens
agttcctgcgagtccct

SEQ ID NO: 9915 - DNA, 17 bp, Homo sapiens
gttcctgcgagtccctc

SEQ ID NO: 9916 - DNA, 17 bp, Homo sapiens
ttcctgcgagtccctct

SEQ ID NO: 9917 - DNA, 17 bp, Homo sapiens
tcctgcgagtccctctt

SEQ ID NO: 9918 - DNA, 17 bp, Homo sapiens
cctgcgagtccctctta

SEQ ID NO: 9919 - DNA, 17 bp, Homo sapiens
ctgcgagtccctcttag

SEQ ID NO: 9920 - DNA, 17 bp, Homo sapiens
tgcgagtccctcttaga

SEQ ID NO: 9921 - DNA, 17 bp, Homo sapiens
gcgagtccctcttagaa

SEQ ID NO: 9922 - DNA, 17 bp, Homo sapiens
cgagtccctcttagaat

SEQ ID NO: 9923 - DNA, 17 bp, Homo sapiens
gagtccctcttagaatc

SEQ ID NO: 9924 - DNA, 17 bp, Homo sapiens
agtccctcttagaatcc

SEQ ID NO: 9925 - DNA, 17 bp, Homo sapiens
gtccctcttagaatcca

SEQ ID NO: 9926 - DNA, 17 bp, Homo sapiens
tccctcttagaatccag

SEQ ID NO: 9927 - DNA, 17 bp, Homo sapiens
ccctcttagaatccaga

SEQ ID NO: 9928 - DNA, 17 bp, Homo sapiens
cctcttagaatccagac

SEQ ID NO: 9929 - DNA, 17 bp, Homo sapiens
ctcttagaatccagacc

SEQ ID NO: 9930 - DNA, 17 bp, Homo sapiens
tcttagaatccagaccg

SEQ ID NO: 9931 - DNA, 17 bp, Homo sapiens
cttagaatccagaccga

SEQ ID NO: 9932 - DNA, 17 bp, Homo sapiens
ttagaatccagaccgag

SEQ ID NO: 9933 - DNA, 17 bp, Homo sapiens
tagaatccagaccgagc

SEQ ID NO: 9934 - DNA, 17 bp, Homo sapiens
agaatccagaccgagca

SEQ ID NO: 9935 - DNA, 17 bp, Homo sapiens
gaatccagaccgagcat

SEQ ID NO: 9936 - DNA, 17 bp, Homo sapiens
aatccagaccgagcatg

SEQ ID NO: 9937 - DNA, 17 bp, Homo sapiens
atccagaccgagcatgg

SEQ ID NO: 9938 - DNA, 17 bp, Homo sapiens
tccagaccgagcatggg

SEQ ID NO: 9939 - DNA, 17 bp, Homo sapiens
ccagaccgagcatgggg

SEQ ID NO: 9940 - DNA, 17 bp, Homo sapiens
cagaccgagcatgggga

SEQ ID NO: 9941 - DNA, 17 bp, Homo sapiens
agaccgagcatggggag

SEQ ID NO: 9942 - DNA, 17 bp, Homo sapiens
gaccgagcatggggaga

SEQ ID NO: 9943 - DNA, 17 bp, Homo sapiens
accgagcatggggagaa

SEQ ID NO: 9944 - DNA, 17 bp, Homo sapiens
ccgagcatggggagaaa

SEQ ID NO: 9945 - DNA, 17 bp, Homo sapiens
cgagcatggggagaaaa

SEQ ID NO: 9946 - DNA, 17 bp, Homo sapiens
gagcatggggagaaaac

SEQ ID NO: 9947 - DNA, 17 bp, Homo sapiens
agcatggggagaaaact

SEQ ID NO: 9948 - DNA, 17 bp, Homo sapiens
gcatggggagaaaactg

SEQ ID NO: 9949 - DNA, 17 bp, Homo sapiens
catggggagaaaactga

SEQ ID NO: 9950 - DNA, 17 bp, Homo sapiens
atggggagaaaactgag

SEQ ID NO: 9951 - DNA, 17 bp, Homo sapiens
tggggagaaaactgagc

SEQ ID NO: 9952 - DNA, 17 bp, Homo sapiens
ggggagaaaactgagct

SEQ ID NO: 9953 - DNA, 17 bp, Homo sapiens
gggagaaaactgagctc

SEQ ID NO: 9954 - DNA, 17 bp, Homo sapiens
ggagaaaactgagctct

SEQ ID NO: 9955 - DNA, 17 bp, Homo sapiens
gagaaaactgagctctc

SEQ ID NO: 9956 - DNA, 17 bp, Homo sapiens
agaaaactgagctctcc

SEQ ID NO: 9957 - DNA, 17 bp, Homo sapiens
gaaaactgagctctccg

SEQ ID NO: 9958 - DNA, 17 bp, Homo sapiens
aaaactgagctctccga

SEQ ID NO: 9959 - DNA, 17 bp, Homo sapiens
aaactgagctctccgac

SEQ ID NO: 9960 - DNA, 17 bp, Homo sapiens
aactgagctctccgacc

SEQ ID NO: 9961 - DNA, 17 bp, Homo sapiens
actgagctctccgacca

SEQ ID NO: 9962 - DNA, 17 bp, Homo sapiens
ctgagctctccgaccac

SEQ ID NO: 9963 - DNA, 17 bp, Homo sapiens
tgagctctccgaccaca

SEQ ID NO: 9964 - DNA, 17 bp, Homo sapiens
gagctctccgaccacac

SEQ ID NO: 9965 - DNA, 17 bp, Homo sapiens
agctctccgaccacacc

SEQ ID NO: 9966 - DNA, 17 bp, Homo sapiens
gctctccgaccacaccc

SEQ ID NO: 9967 - DNA, 17 bp, Homo sapiens
ctctccgaccacaccca

SEQ ID NO: 9968 - DNA, 17 bp, Homo sapiens
tctccgaccacacccag

SEQ ID NO: 9969 - DNA, 17 bp, Homo sapiens
ctccgaccacacccagg

SEQ ID NO: 9970 - DNA, 17 bp, Homo sapiens
tccgaccacacccaggg

SEQ ID NO: 9971 - DNA, 17 bp, Homo sapiens
ccgaccacacccaggga

SEQ ID NO: 9972 - DNA, 17 bp, Homo sapiens
cgaccacacccagggac

SEQ ID NO: 9973 - DNA, 17 bp, Homo sapiens
gaccacacccagggaca

SEQ ID NO: 9974 - DNA, 17 bp, Homo sapiens
accacacccagggacat

SEQ ID NO: 9975 - DNA, 17 bp, Homo sapiens
ccacacccagggacatg

SEQ ID NO: 9976 - DNA, 17 bp, Homo sapiens
cacacccagggacatgc

SEQ ID NO: 9977 - DNA, 17 bp, Homo sapiens
acacccagggacatgct

SEQ ID NO: 9978 - DNA, 17 bp, Homo sapiens
cacccagggacatgctg

SEQ ID NO: 9979 - DNA, 17 bp, Homo sapiens
acccagggacatgctgt

SEQ ID NO: 9980 - DNA, 17 bp, Homo sapiens
cccagggacatgctgtt

SEQ ID NO: 9981 - DNA, 17 bp, Homo sapiens
ccagggacatgctgttg

SEQ ID NO: 9982 - DNA, 17 bp, Homo sapiens
cagggacatgctgttgt

SEQ ID NO: 9983 - DNA, 17 bp, Homo sapiens
agggacatgctgttgtc

SEQ ID NO: 9984 - DNA, 17 bp, Homo sapiens
gggacatgctgttgtcg

SEQ ID NO: 9985 - DNA, 17 bp, Homo sapiens
ggacatgctgttgtcgc

SEQ ID NO: 9986 - DNA, 17 bp, Homo sapiens
gacatgctgttgtcgcc

SEQ ID NO: 9987 - DNA, 17 bp, Homo sapiens
acatgctgttgtcgccc

SEQ ID NO: 9988 - DNA, 17 bp, Homo sapiens
catgctgttgtcgccca

SEQ ID NO: 9989 - DNA, 17 bp, Homo sapiens
atgctgttgtcgcccac

SEQ ID NO: 9990 - DNA, 17 bp, Homo sapiens
tgctgttgtcgcccaca

SEQ ID NO: 9991 - DNA, 17 bp, Homo sapiens
gctgttgtcgcccacac

SEQ ID NO: 9992 - DNA, 17 bp, Homo sapiens
ctgttgtcgcccacact

SEQ ID NO: 9993 - DNA, 17 bp, Homo sapiens
tgttgtcgcccacactg

SEQ ID NO: 9994 - DNA, 17 bp, Homo sapiens
gttgtcgcccacactgc

SEQ ID NO: 9995 - DNA, 17 bp, Homo sapiens
ttgtcgcccacactgcg

SEQ ID NO: 9996 - DNA, 17 bp, Homo sapiens
tgtcgcccacactgcgt

SEQ ID NO: 9997 - DNA, 17 bp, Homo sapiens
gtcgcccacactgcgtc

SEQ ID NO: 9998 - DNA, 17 bp, Homo sapiens
tcgcccacactgcgtcc

SEQ ID NO: 9999 - DNA, 17 bp, Homo sapiens
cgcccacactgcgtcct

SEQ ID NO: 10000 - DNA, 17 bp, Homo sapiens
gcccacactgcgtcctc

SEQ ID NO: 10001 - DNA, 17 bp, Homo sapiens
cccacactgcgtcctcg

SEQ ID NO: 10002 - DNA, 17 bp, Homo sapiens
ccacactgcgtcctcgg

SEQ ID NO: 10003 - DNA, 17 bp, Homo sapiens
cacactgcgtcctcgga

SEQ ID NO: 10004 - DNA, 17 bp, Homo sapiens
acactgcgtcctcggag

SEQ ID NO: 10005 - DNA, 17 bp, Homo sapiens
cactgcgtcctcggagg

SEQ ID NO: 10006 - DNA, 17 bp, Homo sapiens
actgcgtcctcggaggc

SEQ ID NO: 10007 - DNA, 17 bp, Homo sapiens
ctgcgtcctcggaggcg

SEQ ID NO: 10008 - DNA, 17 bp, Homo sapiens
tgcgtcctcggaggcgg

SEQ ID NO: 10009 - DNA, 17 bp, Homo sapiens
gcgtcctcggaggcggt

SEQ ID NO: 10010 - DNA, 17 bp, Homo sapiens
cgtcctcggaggcggtg

SEQ ID NO: 10011 - DNA, 17 bp, Homo sapiens
gtcctcggaggcggtgt

SEQ ID NO: 10012 - DNA, 17 bp, Homo sapiens
tcctcggaggcggtgtc

SEQ ID NO: 10013 - DNA, 17 bp, Homo sapiens
cctcggaggcggtgtct

SEQ ID NO: 10014 - DNA, 17 bp, Homo sapiens
ctcggaggcggtgtctg

SEQ ID NO: 10015 - DNA, 17 bp, Homo sapiens
tcggaggcggtgtctgg

SEQ ID NO: 10016 - DNA, 17 bp, Homo sapiens
cggaggcggtgtctgga

SEQ ID NO: 10017 - DNA, 17 bp, Homo sapiens
ggaggcggtgtctggag

SEQ ID NO: 10018 - DNA, 17 bp, Homo sapiens
gaggcggtgtctggagt

SEQ ID NO: 10019 - DNA, 17 bp, Homo sapiens
aggcggtgtctggagtc

SEQ ID NO: 10020 - DNA, 17 bp, Homo sapiens
ggcggtgtctggagtcc

SEQ ID NO: 10021 - DNA, 17 bp, Homo sapiens
gcggtgtctggagtcct

SEQ ID NO: 10022 - DNA, 17 bp, Homo sapiens
cggtgtctggagtcctc

SEQ ID NO: 10023 - DNA, 17 bp, Homo sapiens
ggtgtctggagtcctct

SEQ ID NO: 10024 - DNA, 17 bp, Homo sapiens
gtgtctggagtcctctg

SEQ ID NO: 10025 - DNA, 17 bp, Homo sapiens
tgtctggagtcctctgt

SEQ ID NO: 10026 - DNA, 17 bp, Homo sapiens
gtctggagtcctctgtg

SEQ ID NO: 10027 - DNA, 17 bp, Homo sapiens
tctggagtcctctgtgg

SEQ ID NO: 10028 - DNA, 17 bp, Homo sapiens
ctggagtcctctgtgga

SEQ ID NO: 10029 - DNA, 17 bp, Homo sapiens
tggagtcctctgtggac

SEQ ID NO: 10030 - DNA, 17 bp, Homo sapiens
ggagtcctctgtggacg

SEQ ID NO: 10031 - DNA, 17 bp, Homo sapiens
gagtcctctgtggacga

SEQ ID NO: 10032 - DNA, 17 bp, Homo sapiens
agtcctctgtggacgat

SEQ ID NO: 10033 - DNA, 17 bp, Homo sapiens
gtcctctgtggacgatg

SEQ ID NO: 10034 - DNA, 17 bp, Homo sapiens
tcctctgtggacgatgc

SEQ ID NO: 10035 - DNA, 17 bp, Homo sapiens
cctctgtggacgatgcg

SEQ ID NO: 10036 - DNA, 17 bp, Homo sapiens
ctctgtggacgatgcgg

SEQ ID NO: 10037 - DNA, 17 bp, Homo sapiens
tctgtggacgatgcggg

SEQ ID NO: 10038 - DNA, 17 bp, Homo sapiens
ctgtggacgatgcgggc

SEQ ID NO: 10039 - DNA, 17 bp, Homo sapiens
tgtggacgatgcgggct

SEQ ID NO: 10040 - DNA, 17 bp, Homo sapiens
gtggacgatgcgggctg

SEQ ID NO: 10041 - DNA, 17 bp, Homo sapiens
tggacgatgcgggctgt

SEQ ID NO: 10042 - DNA, 17 bp, Homo sapiens
ggacgatgcgggctgtc

SEQ ID NO: 10043 - DNA, 17 bp, Homo sapiens
gacgatgcgggctgtcc

SEQ ID NO: 10044 - DNA, 17 bp, Homo sapiens
acgatgcgggctgtcca

SEQ ID NO: 10045 - DNA, 17 bp, Homo sapiens
cgatgcgggctgtccag

SEQ ID NO: 10046 - DNA, 17 bp, Homo sapiens
gatgcgggctgtccaga

SEQ ID NO: 10047 - DNA, 17 bp, Homo sapiens
atgcgggctgtccagac

SEQ ID NO: 10048 - DNA, 17 bp, Homo sapiens
tgcgggctgtccagacc

SEQ ID NO: 10049 - DNA, 17 bp, Homo sapiens
gcgggctgtccagacct

SEQ ID NO: 10050 - DNA, 17 bp, Homo sapiens
cgggctgtccagacctt

SEQ ID NO: 10051 - DNA, 17 bp, Homo sapiens
gggctgtccagaccttg

SEQ ID NO: 10052 - DNA, 17 bp, Homo sapiens
ggctgtccagaccttgg

SEQ ID NO: 10053 - DNA, 17 bp, Homo sapiens
gctgtccagaccttgga

SEQ ID NO: 10054 - DNA, 17 bp, Homo sapiens
ctgtccagaccttggaa

SEQ ID NO: 10055 - DNA, 17 bp, Homo sapiens
tgtccagaccttggaaa

SEQ ID NO: 10056 - DNA, 17 bp, Homo sapiens
gtccagaccttggaaag

SEQ ID NO: 10057 - DNA, 17 bp, Homo sapiens
tccagaccttggaaagg

SEQ ID NO: 10058 - DNA, 17 bp, Homo sapiens
ccagaccttggaaagga

SEQ ID NO: 10059 - DNA, 17 bp, Homo sapiens
cagaccttggaaaggag

SEQ ID NO: 10060 - DNA, 17 bp, Homo sapiens
agaccttggaaaggagc

SEQ ID NO: 10061 - DNA, 17 bp, Homo sapiens
gaccttggaaaggagcc

SEQ ID NO: 10062 - DNA, 17 bp, Homo sapiens
accttggaaaggagccg

SEQ ID NO: 10063 - DNA, 17 bp, Homo sapiens
ccttggaaaggagccgc

SEQ ID NO: 10064 - DNA, 17 bp, Homo sapiens
cttggaaaggagccgct

SEQ ID NO: 10065 - DNA, 17 bp, Homo sapiens
ttggaaaggagccgctt

SEQ ID NO: 10066 - DNA, 17 bp, Homo sapiens
tggaaaggagccgcttg

SEQ ID NO: 10067 - DNA, 17 bp, Homo sapiens
ggaaaggagccgcttgt

SEQ ID NO: 10068 - DNA, 17 bp, Homo sapiens
gaaaggagccgcttgtt

SEQ ID NO: 10069 - DNA, 17 bp, Homo sapiens
aaaggagccgcttgttt

SEQ ID NO: 10070 - DNA, 17 bp, Homo sapiens
aaggagccgcttgtttt

SEQ ID NO: 10071 - DNA, 17 bp, Homo sapiens
aggagccgcttgttttc

SEQ ID NO: 10072 - DNA, 17 bp, Homo sapiens
ggagccgcttgttttcc

SEQ ID NO: 10073 - DNA, 17 bp, Homo sapiens
gagccgcttgttttcca

SEQ ID NO: 10074 - DNA, 17 bp, Homo sapiens
agccgcttgttttccag

SEQ ID NO: 10075 - DNA, 17 bp, Homo sapiens
gccgcttgttttccaga

SEQ ID NO: 10076 - DNA, 17 bp, Homo sapiens
ccgcttgttttccagaa

SEQ ID NO: 10077 - DNA, 17 bp, Homo sapiens
cgcttgttttccagaac

SEQ ID NO: 10078 - DNA, 17 bp, Homo sapiens
gcttgttttccagaacc

SEQ ID NO: 10079 - DNA, 17 bp, Homo sapiens
cttgttttccagaaccg

SEQ ID NO: 10080 - DNA, 17 bp, Homo sapiens
ttgttttccagaaccgc

SEQ ID NO: 10081 - DNA, 17 bp, Homo sapiens
tgttttccagaaccgcc

SEQ ID NO: 10082 - DNA, 17 bp, Homo sapiens
gttttccagaaccgcca

SEQ ID NO: 10083 - DNA, 17 bp, Homo sapiens
ttttccagaaccgccag

SEQ ID NO: 10084 - DNA, 17 bp, Homo sapiens
tttccagaaccgccagt

SEQ ID NO: 10085 - DNA, 17 bp, Homo sapiens
ttccagaaccgccagtt

SEQ ID NO: 10086 - DNA, 17 bp, Homo sapiens
tccagaaccgccagttt

SEQ ID NO: 10087 - DNA, 17 bp, Homo sapiens
ccagaaccgccagtttg

SEQ ID NO: 10088 - DNA, 17 bp, Homo sapiens
cagaaccgccagtttgc

SEQ ID NO: 10089 - DNA, 17 bp, Homo sapiens
agaaccgccagtttgcc

SEQ ID NO: 10090 - DNA, 17 bp, Homo sapiens
gaaccgccagtttgccc

SEQ ID NO: 10091 - DNA, 17 bp, Homo sapiens
aaccgccagtttgccca

SEQ ID NO: 10092 - DNA, 17 bp, Homo sapiens
accgccagtttgcccac

SEQ ID NO: 10093 - DNA, 17 bp, Homo sapiens
ccgccagtttgcccacc

SEQ ID NO: 10094 - DNA, 17 bp, Homo sapiens
cgccagtttgcccacct

SEQ ID NO: 10095 - DNA, 17 bp, Homo sapiens
gccagtttgcccacctg

SEQ ID NO: 10096 - DNA, 17 bp, Homo sapiens
ccagtttgcccacctga

SEQ ID NO: 10097 - DNA, 17 bp, Homo sapiens
cagtttgcccacctgat

SEQ ID NO: 10098 - DNA, 17 bp, Homo sapiens
agtttgcccacctgatg

SEQ ID NO: 10099 - DNA, 17 bp, Homo sapiens
gtttgcccacctgatgg

SEQ ID NO: 10100 - DNA, 17 bp, Homo sapiens
tttgcccacctgatgga

SEQ ID NO: 10101 - DNA, 17 bp, Homo sapiens
ttgcccacctgatggag

SEQ ID NO: 10102 - DNA, 17 bp, Homo sapiens
tgcccacctgatggagg

SEQ ID NO: 10103 - DNA, 17 bp, Homo sapiens
gcccacctgatggagga

SEQ ID NO: 10104 - DNA, 17 bp, Homo sapiens
cccacctgatggaggaa

SEQ ID NO: 10105 - DNA, 17 bp, Homo sapiens
ccacctgatggaggaac

SEQ ID NO: 10106 - DNA, 17 bp, Homo sapiens
cacctgatggaggaacc

SEQ ID NO: 10107 - DNA, 17 bp, Homo sapiens
acctgatggaggaacct

SEQ ID NO: 10108 - DNA, 17 bp, Homo sapiens
cctgatggaggaacctc

SEQ ID NO: 10109 - DNA, 17 bp, Homo sapiens
ctgatggaggaacctct

SEQ ID NO: 10110 - DNA, 17 bp, Homo sapiens
tgatggaggaacctcta

SEQ ID NO: 10111 - DNA, 17 bp, Homo sapiens
gatggaggaacctctag

SEQ ID NO: 10112 - DNA, 17 bp, Homo sapiens
atggaggaacctctagg

SEQ ID NO: 10113 - DNA, 17 bp, Homo sapiens
tggaggaacctctaggc

SEQ ID NO: 10114 - DNA, 17 bp, Homo sapiens
ggaggaacctctaggca

SEQ ID NO: 10115 - DNA, 17 bp, Homo sapiens
gaggaacctctaggcag

SEQ ID NO: 10116 - DNA, 17 bp, Homo sapiens
aggaacctctaggcagt

SEQ ID NO: 10117 - DNA, 17 bp, Homo sapiens
ggaacctctaggcagtg

SEQ ID NO: 10118 - DNA, 17 bp, Homo sapiens
gaacctctaggcagtga

SEQ ID NO: 10119 - DNA, 17 bp, Homo sapiens
aacctctaggcagtgac

SEQ ID NO: 10120 - DNA, 17 bp, Homo sapiens
acctctaggcagtgacc

SEQ ID NO: 10121 - DNA, 17 bp, Homo sapiens
cctctaggcagtgaccc

SEQ ID NO: 10122 - DNA, 17 bp, Homo sapiens
ctctaggcagtgaccca

SEQ ID NO: 10123 - DNA, 17 bp, Homo sapiens
tctaggcagtgacccat

SEQ ID NO: 10124 - DNA, 17 bp, Homo sapiens
ctaggcagtgacccatt

SEQ ID NO: 10125 - DNA, 17 bp, Homo sapiens
taggcagtgacccattc

SEQ ID NO: 10126 - DNA, 17 bp, Homo sapiens
aggcagtgacccattca

SEQ ID NO: 10127 - DNA, 17 bp, Homo sapiens
ggcagtgacccattcag

SEQ ID NO: 10128 - DNA, 17 bp, Homo sapiens
gcagtgacccattcagc

SEQ ID NO: 10129 - DNA, 17 bp, Homo sapiens
cagtgacccattcagct

SEQ ID NO: 10130 - DNA, 17 bp, Homo sapiens
agtgacccattcagctg

SEQ ID NO: 10131 - DNA, 17 bp, Homo sapiens
gtgacccattcagctgg

SEQ ID NO: 10132 - DNA, 17 bp, Homo sapiens
tgacccattcagctgga

SEQ ID NO: 10133 - DNA, 17 bp, Homo sapiens
gacccattcagctggaa

SEQ ID NO: 10134 - DNA, 17 bp, Homo sapiens
acccattcagctggaaa

SEQ ID NO: 10135 - DNA, 17 bp, Homo sapiens
cccattcagctggaaac

SEQ ID NO: 10136 - DNA, 17 bp, Homo sapiens
ccattcagctggaaact

SEQ ID NO: 10137 - DNA, 17 bp, Homo sapiens
cattcagctggaaactc

SEQ ID NO: 10138 - DNA, 17 bp, Homo sapiens
attcagctggaaactcc

SEQ ID NO: 10139 - DNA, 17 bp, Homo sapiens
ttcagctggaaactccc

SEQ ID NO: 10140 - DNA, 17 bp, Homo sapiens
tcagctggaaactccca

SEQ ID NO: 10141 - DNA, 17 bp, Homo sapiens
cagctggaaactcccaa

SEQ ID NO: 10142 - DNA, 17 bp, Homo sapiens
agctggaaactcccaag

SEQ ID NO: 10143 - DNA, 17 bp, Homo sapiens
gctggaaactcccaagc

SEQ ID NO: 10144 - DNA, 17 bp, Homo sapiens
ctggaaactcccaagcc

SEQ ID NO: 10145 - DNA, 17 bp, Homo sapiens
tggaaactcccaagcct

SEQ ID NO: 10146 - DNA, 17 bp, Homo sapiens
ggaaactcccaagcctc

SEQ ID NO: 10147 - DNA, 17 bp, Homo sapiens
gaaactcccaagcctcg

SEQ ID NO: 10148 - DNA, 17 bp, Homo sapiens
aaactcccaagcctcga

SEQ ID NO: 10149 - DNA, 17 bp, Homo sapiens
aactcccaagcctcgac

SEQ ID NO: 10150 - DNA, 17 bp, Homo sapiens
actcccaagcctcgact

SEQ ID NO: 10151 - DNA, 17 bp, Homo sapiens
ctcccaagcctcgacta

SEQ ID NO: 10152 - DNA, 17 bp, Homo sapiens
tcccaagcctcgactac

SEQ ID NO: 10153 - DNA, 17 bp, Homo sapiens
cccaagcctcgactacg

SEQ ID NO: 10154 - DNA, 17 bp, Homo sapiens
ccaagcctcgactacga

SEQ ID NO: 10155 - DNA, 17 bp, Homo sapiens
caagcctcgactacgaa

SEQ ID NO: 10156 - DNA, 17 bp, Homo sapiens
aagcctcgactacgaac

SEQ ID NO: 10157 - DNA, 17 bp, Homo sapiens
agcctcgactacgaacg

SEQ ID NO: 10158 - DNA, 17 bp, Homo sapiens
gcctcgactacgaacgc

SEQ ID NO: 10159 - DNA, 17 bp, Homo sapiens
cctcgactacgaacgca

SEQ ID NO: 10160 - DNA, 17 bp, Homo sapiens
ctcgactacgaacgcaa

SEQ ID NO: 10161 - DNA, 17 bp, Homo sapiens
tcgactacgaacgcaag

SEQ ID NO: 10162 - DNA, 17 bp, Homo sapiens
cgactacgaacgcaaga

SEQ ID NO: 10163 - DNA, 17 bp, Homo sapiens
gactacgaacgcaagac

SEQ ID NO: 10164 - DNA, 17 bp, Homo sapiens
actacgaacgcaagacc

SEQ ID NO: 10165 - DNA, 17 bp, Homo sapiens
ctacgaacgcaagacca

SEQ ID NO: 10166 - DNA, 17 bp, Homo sapiens
tacgaacgcaagaccaa

SEQ ID NO: 10167 - DNA, 17 bp, Homo sapiens
acgaacgcaagaccaaa

SEQ ID NO: 10168 - DNA, 17 bp, Homo sapiens
cgaacgcaagaccaaag

SEQ ID NO: 10169 - DNA, 17 bp, Homo sapiens
gaacgcaagaccaaagt

SEQ ID NO: 10170 - DNA, 17 bp, Homo sapiens
aacgcaagaccaaagtg

SEQ ID NO: 10171 - DNA, 17 bp, Homo sapiens
acgcaagaccaaagtgg

SEQ ID NO: 10172 - DNA, 17 bp, Homo sapiens
cgcaagaccaaagtgga

SEQ ID NO: 10173 - DNA, 17 bp, Homo sapiens
gcaagaccaaagtggac

SEQ ID NO: 10174 - DNA, 17 bp, Homo sapiens
caagaccaaagtggact

SEQ ID NO: 10175 - DNA, 17 bp, Homo sapiens
aagaccaaagtggactt

SEQ ID NO: 10176 - DNA, 17 bp, Homo sapiens
agaccaaagtggacttc

SEQ ID NO: 10177 - DNA, 17 bp, Homo sapiens
gaccaaagtggacttcg

SEQ ID NO: 10178 - DNA, 17 bp, Homo sapiens
accaaagtggacttcga

SEQ ID NO: 10179 - DNA, 17 bp, Homo sapiens
ccaaagtggacttcgat

SEQ ID NO: 10180 - DNA, 17 bp, Homo sapiens
caaagtggacttcgatg

SEQ ID NO: 10181 - DNA, 17 bp, Homo sapiens
aaagtggacttcgatga

SEQ ID NO: 10182 - DNA, 17 bp, Homo sapiens
aagtggacttcgatgac

SEQ ID NO: 10183 - DNA, 17 bp, Homo sapiens
agtggacttcgatgact

SEQ ID NO: 10184 - DNA, 17 bp, Homo sapiens
gtggacttcgatgactt

SEQ ID NO: 10185 - DNA, 17 bp, Homo sapiens
tggacttcgatgacttc

SEQ ID NO: 10186 - DNA, 17 bp, Homo sapiens
ggacttcgatgacttcc

SEQ ID NO: 10187 - DNA, 17 bp, Homo sapiens
gacttcgatgacttcct

SEQ ID NO: 10188 - DNA, 17 bp, Homo sapiens
acttcgatgacttcctc

SEQ ID NO: 10189 - DNA, 17 bp, Homo sapiens
cttcgatgacttcctcc

SEQ ID NO: 10190 - DNA, 17 bp, Homo sapiens
ttcgatgacttcctccc

SEQ ID NO: 10191 - DNA, 17 bp, Homo sapiens
tcgatgacttcctccca

SEQ ID NO: 10192 - DNA, 17 bp, Homo sapiens
cgatgacttcctcccag

SEQ ID NO: 10193 - DNA, 17 bp, Homo sapiens
gatgacttcctcccagc

SEQ ID NO: 10194 - DNA, 17 bp, Homo sapiens
atgacttcctcccagct

SEQ ID NO: 10195 - DNA, 17 bp, Homo sapiens
tgacttcctcccagcta

SEQ ID NO: 10196 - DNA, 17 bp, Homo sapiens
gacttcctcccagctat

SEQ ID NO: 10197 - DNA, 17 bp, Homo sapiens
acttcctcccagctatc

SEQ ID NO: 10198 - DNA, 17 bp, Homo sapiens
cttcctcccagctatcc

SEQ ID NO: 10199 - DNA, 17 bp, Homo sapiens
ttcctcccagctatccg

SEQ ID NO: 10200 - DNA, 17 bp, Homo sapiens
tcctcccagctatccgg

SEQ ID NO: 10201 - DNA, 17 bp, Homo sapiens
cctcccagctatccgga

SEQ ID NO: 10202 - DNA, 17 bp, Homo sapiens
ctcccagctatccggaa

SEQ ID NO: 10203 - DNA, 17 bp, Homo sapiens
tcccagctatccggaag

SEQ ID NO: 10204 - DNA, 17 bp, Homo sapiens
cccagctatccggaagc

SEQ ID NO: 10205 - DNA, 17 bp, Homo sapiens
ccagctatccggaagcc

SEQ ID NO: 10206 - DNA, 17 bp, Homo sapiens
cagctatccggaagccc

SEQ ID NO: 10207 - DNA, 17 bp, Homo sapiens
agctatccggaagcccc

SEQ ID NO: 10208 - DNA, 17 bp, Homo sapiens
gctatccggaagcccca

SEQ ID NO: 10209 - DNA, 17 bp, Homo sapiens
ctatccggaagccccag

SEQ ID NO: 10210 - DNA, 17 bp, Homo sapiens
tatccggaagccccaga

SEQ ID NO: 10211 - DNA, 17 bp, Homo sapiens
atccggaagccccagac

SEQ ID NO: 10212 - DNA, 17 bp, Homo sapiens
tccggaagccccagaca

SEQ ID NO: 10213 - DNA, 17 bp, Homo sapiens
ccggaagccccagacac

SEQ ID NO: 10214 - DNA, 17 bp, Homo sapiens
cggaagccccagacacc

SEQ ID NO: 10215 - DNA, 17 bp, Homo sapiens
ggaagccccagacacct

SEQ ID NO: 10216 - DNA, 17 bp, Homo sapiens
gaagccccagacaccta

SEQ ID NO: 10217 - DNA, 17 bp, Homo sapiens
aagccccagacacctac

SEQ ID NO: 10218 - DNA, 17 bp, Homo sapiens
agccccagacacctacc

SEQ ID NO: 10219 - DNA, 17 bp, Homo sapiens
gccccagacacctacct

SEQ ID NO: 10220 - DNA, 17 bp, Homo sapiens
ccccagacacctacctc

SEQ ID NO: 10221 - DNA, 17 bp, Homo sapiens
cccagacacctacctcc

SEQ ID NO: 10222 - DNA, 17 bp, Homo sapiens
ccagacacctacctcct

SEQ ID NO: 10223 - DNA, 17 bp, Homo sapiens
cagacacctacctcctt

SEQ ID NO: 10224 - DNA, 17 bp, Homo sapiens
agacacctacctccttg

SEQ ID NO: 10225 - DNA, 17 bp, Homo sapiens
gacacctacctccttgg

SEQ ID NO: 10226 - DNA, 17 bp, Homo sapiens
acacctacctccttggc

SEQ ID NO: 10227 - DNA, 17 bp, Homo sapiens
cacctacctccttggct

SEQ ID NO: 10228 - DNA, 17 bp, Homo sapiens
acctacctccttggctg

SEQ ID NO: 10229 - DNA, 17 bp, Homo sapiens
cctacctccttggctgg

SEQ ID NO: 10230 - DNA, 17 bp, Homo sapiens
ctacctccttggctgga

SEQ ID NO: 10231 - DNA, 17 bp, Homo sapiens
tacctccttggctggat

SEQ ID NO: 10232 - DNA, 17 bp, Homo sapiens
acctccttggctggatc

SEQ ID NO: 10233 - DNA, 17 bp, Homo sapiens
cctccttggctggatca

SEQ ID NO: 10234 - DNA, 17 bp, Homo sapiens
ctccttggctggatcag

SEQ ID NO: 10235 - DNA, 17 bp, Homo sapiens
tccttggctggatcagc

SEQ ID NO: 10236 - DNA, 17 bp, Homo sapiens
ccttggctggatcagcc

SEQ ID NO: 10237 - DNA, 17 bp, Homo sapiens
cttggctggatcagcca

SEQ ID NO: 10238 - DNA, 17 bp, Homo sapiens
ttggctggatcagccaa

SEQ ID NO: 10239 - DNA, 17 bp, Homo sapiens
tggctggatcagccaaa

SEQ ID NO: 10240 - DNA, 17 bp, Homo sapiens
ggctggatcagccaaag

SEQ ID NO: 10241 - DNA, 17 bp, Homo sapiens
gctggatcagccaaagg

SEQ ID NO: 10242 - DNA, 17 bp, Homo sapiens
ctggatcagccaaaggt

SEQ ID NO: 10243 - DNA, 17 bp, Homo sapiens
tggatcagccaaaggtg

SEQ ID NO: 10244 - DNA, 17 bp, Homo sapiens
ggatcagccaaaggtgg

SEQ ID NO: 10245 - DNA, 17 bp, Homo sapiens
gatcagccaaaggtggg

SEQ ID NO: 10246 - DNA, 17 bp, Homo sapiens
atcagccaaaggtgggc

SEQ ID NO: 10247 - DNA, 17 bp, Homo sapiens
tcagccaaaggtgggca

SEQ ID NO: 10248 - DNA, 17 bp, Homo sapiens
cagccaaaggtgggcaa

SEQ ID NO: 10249 - DNA, 17 bp, Homo sapiens
agccaaaggtgggcaag

SEQ ID NO: 10250 - DNA, 17 bp, Homo sapiens
gccaaaggtgggcaaga

SEQ ID NO: 10251 - DNA, 17 bp, Homo sapiens
ccaaaggtgggcaagac

SEQ ID NO: 10252 - DNA, 17 bp, Homo sapiens
caaaggtgggcaagacg

SEQ ID NO: 10253 - DNA, 17 bp, Homo sapiens
aaaggtgggcaagacgg

SEQ ID NO: 10254 - DNA, 17 bp, Homo sapiens
aaggtgggcaagacggt

SEQ ID NO: 10255 - DNA, 17 bp, Homo sapiens
aggtgggcaagacggtt

SEQ ID NO: 10256 - DNA, 17 bp, Homo sapiens
ggtgggcaagacggttc

SEQ ID NO: 10257 - DNA, 17 bp, Homo sapiens
gtgggcaagacggttca

SEQ ID NO: 10258 - DNA, 17 bp, Homo sapiens
tgggcaagacggttcac

SEQ ID NO: 10259 - DNA, 17 bp, Homo sapiens
gggcaagacggttcaca

SEQ ID NO: 10260 - DNA, 17 bp, Homo sapiens
ggcaagacggttcacag

SEQ ID NO: 10261 - DNA, 17 bp, Homo sapiens
gcaagacggttcacagc

SEQ ID NO: 10262 - DNA, 17 bp, Homo sapiens
caagacggttcacagcg

SEQ ID NO: 10263 - DNA, 17 bp, Homo sapiens
aagacggttcacagcgt

SEQ ID NO: 10264 - DNA, 17 bp, Homo sapiens
agacggttcacagcgtt

SEQ ID NO: 10265 - DNA, 17 bp, Homo sapiens
gacggttcacagcgttc

SEQ ID NO: 10266 - DNA, 17 bp, Homo sapiens
acggttcacagcgttca

SEQ ID NO: 10267 - DNA, 17 bp, Homo sapiens
cggttcacagcgttcaa

SEQ ID NO: 10268 - DNA, 17 bp, Homo sapiens
ggttcacagcgttcaag

SEQ ID NO: 10269 - DNA, 17 bp, Homo sapiens
gttcacagcgttcaagc

SEQ ID NO: 10270 - DNA, 17 bp, Homo sapiens
ttcacagcgttcaagca

SEQ ID NO: 10271 - DNA, 17 bp, Homo sapiens
tcacagcgttcaagcat

SEQ ID NO: 10272 - DNA, 17 bp, Homo sapiens
cacagcgttcaagcatc

SEQ ID NO: 10273 - DNA, 17 bp, Homo sapiens
acagcgttcaagcatcc

SEQ ID NO: 10274 - DNA, 17 bp, Homo sapiens
cagcgttcaagcatcca

SEQ ID NO: 10275 - DNA, 17 bp, Homo sapiens
agcgttcaagcatccac

SEQ ID NO: 10276 - DNA, 17 bp, Homo sapiens
gcgttcaagcatccact

SEQ ID NO: 10277 - DNA, 17 bp, Homo sapiens
cgttcaagcatccactt

SEQ ID NO: 10278 - DNA, 17 bp, Homo sapiens
gttcaagcatccacttt

SEQ ID NO: 10279 - DNA, 17 bp, Homo sapiens
ttcaagcatccactttg

SEQ ID NO: 10280 - DNA, 17 bp, Homo sapiens
tcaagcatccactttga

SEQ ID NO: 10281 - DNA, 17 bp, Homo sapiens
caagcatccactttgaa

SEQ ID NO: 10282 - DNA, 17 bp, Homo sapiens
aagcatccactttgaaa

SEQ ID NO: 10283 - DNA, 17 bp, Homo sapiens
agcatccactttgaaac

SEQ ID NO: 10284 - DNA, 17 bp, Homo sapiens
gcatccactttgaaacg

SEQ ID NO: 10285 - DNA, 17 bp, Homo sapiens
catccactttgaaacgg

SEQ ID NO: 10286 - DNA, 17 bp, Homo sapiens
atccactttgaaacgga

SEQ ID NO: 10287 - DNA, 17 bp, Homo sapiens
tccactttgaaacggaa

SEQ ID NO: 10288 - DNA, 17 bp, Homo sapiens
ccactttgaaacggaag

SEQ ID NO: 10289 - DNA, 17 bp, Homo sapiens
cactttgaaacggaaga

SEQ ID NO: 10290 - DNA, 17 bp, Homo sapiens
actttgaaacggaagag

SEQ ID NO: 10291 - DNA, 17 bp, Homo sapiens
ctttgaaacggaagagg

SEQ ID NO: 10292 - DNA, 17 bp, Homo sapiens
tttgaaacggaagaggc

SEQ ID NO: 10293 - DNA, 17 bp, Homo sapiens
ttgaaacggaagaggct

SEQ ID NO: 10294 - DNA, 17 bp, Homo sapiens
tgaaacggaagaggcta

SEQ ID NO: 10295 - DNA, 17 bp, Homo sapiens
gaaacggaagaggctaa

SEQ ID NO: 10296 - DNA, 17 bp, Homo sapiens
aaacggaagaggctaac

SEQ ID NO: 10297 - DNA, 17 bp, Homo sapiens
aacggaagaggctaacc

SEQ ID NO: 10298 - DNA, 17 bp, Homo sapiens
acggaagaggctaaccg

SEQ ID NO: 10299 - DNA, 17 bp, Homo sapiens
cggaagaggctaaccgt

SEQ ID NO: 10300 - DNA, 17 bp, Homo sapiens
ggaagaggctaaccgtt

SEQ ID NO: 10301 - DNA, 17 bp, Homo sapiens
gaagaggctaaccgttc

SEQ ID NO: 10302 - DNA, 17 bp, Homo sapiens
aagaggctaaccgttcc

SEQ ID NO: 10303 - DNA, 17 bp, Homo sapiens
agaggctaaccgttcct

SEQ ID NO: 10304 - DNA, 17 bp, Homo sapiens
gaggctaaccgttcctt

SEQ ID NO: 10305 - DNA, 17 bp, Homo sapiens
aggctaaccgttccttt

SEQ ID NO: 10306 - DNA, 17 bp, Homo sapiens
ggctaaccgttcctttc

SEQ ID NO: 10307 - DNA, 17 bp, Homo sapiens
gctaaccgttcctttct

SEQ ID NO: 10308 - DNA, 17 bp, Homo sapiens
ctaaccgttcctttctc

SEQ ID NO: 10309 - DNA, 17 bp, Homo sapiens
taaccgttcctttctct

SEQ ID NO: 10310 - DNA, 17 bp, Homo sapiens
aaccgttcctttctctc

SEQ ID NO: 10311 - DNA, 17 bp, Homo sapiens
accgttcctttctctcg

SEQ ID NO: 10312 - DNA, 17 bp, Homo sapiens
ccgttcctttctctcgg

SEQ ID NO: 10313 - DNA, 17 bp, Homo sapiens
cgttcctttctctcggg

SEQ ID NO: 10314 - DNA, 17 bp, Homo sapiens
gttcctttctctcgggg

SEQ ID NO: 10315 - DNA, 17 bp, Homo sapiens
ttcctttctctcgggga

SEQ ID NO: 10316 - DNA, 17 bp, Homo sapiens
tcctttctctcggggat

SEQ ID NO: 10317 - DNA, 17 bp, Homo sapiens
cctttctctcggggatc

SEQ ID NO: 10318 - DNA, 17 bp, Homo sapiens
ctttctctcggggatca

SEQ ID NO: 10319 - DNA, 17 bp, Homo sapiens
tttctctcggggatcaa

SEQ ID NO: 10320 - DNA, 17 bp, Homo sapiens
ttctctcggggatcaag

SEQ ID NO: 10321 - DNA, 17 bp, Homo sapiens
tctctcggggatcaaga

SEQ ID NO: 10322 - DNA, 17 bp, Homo sapiens
ctctcggggatcaagac

SEQ ID NO: 10323 - DNA, 17 bp, Homo sapiens
tctcggggatcaagacc

SEQ ID NO: 10324 - DNA, 17 bp, Homo sapiens
ctcggggatcaagacca

SEQ ID NO: 10325 - DNA, 17 bp, Homo sapiens
tcggggatcaagaccat

SEQ ID NO: 10326 - DNA, 17 bp, Homo sapiens
cggggatcaagaccatt

SEQ ID NO: 10327 - DNA, 17 bp, Homo sapiens
ggggatcaagaccattt

SEQ ID NO: 10328 - DNA, 17 bp, Homo sapiens
gggatcaagaccatttt

SEQ ID NO: 10329 - DNA, 17 bp, Homo sapiens
ggatcaagaccattttg

SEQ ID NO: 10330 - DNA, 17 bp, Homo sapiens
gatcaagaccattttga

SEQ ID NO: 10331 - DNA, 17 bp, Homo sapiens
atcaagaccattttgaa

SEQ ID NO: 10332 - DNA, 17 bp, Homo sapiens
tcaagaccattttgaag

SEQ ID NO: 10333 - DNA, 17 bp, Homo sapiens
caagaccattttgaaga

SEQ ID NO: 10334 - DNA, 17 bp, Homo sapiens
aagaccattttgaagaa

SEQ ID NO: 10335 - DNA, 17 bp, Homo sapiens
agaccattttgaagaag

SEQ ID NO: 10336 - DNA, 17 bp, Homo sapiens
gaccattttgaagaaga

SEQ ID NO: 10337 - DNA, 17 bp, Homo sapiens
accattttgaagaagag

SEQ ID NO: 10338 - DNA, 17 bp, Homo sapiens
ccattttgaagaagagc

SEQ ID NO: 10339 - DNA, 17 bp, Homo sapiens
cattttgaagaagagcc

SEQ ID NO: 10340 - DNA, 17 bp, Homo sapiens
attttgaagaagagccc

SEQ ID NO: 10341 - DNA, 17 bp, Homo sapiens
ttttgaagaagagcccg

SEQ ID NO: 10342 - DNA, 17 bp, Homo sapiens
tttgaagaagagcccgg

SEQ ID NO: 10343 - DNA, 17 bp, Homo sapiens
ttgaagaagagcccgga

SEQ ID NO: 10344 - DNA, 17 bp, Homo sapiens
tgaagaagagcccggag

SEQ ID NO: 10345 - DNA, 17 bp, Homo sapiens
gaagaagagcccggagc

SEQ ID NO: 10346 - DNA, 17 bp, Homo sapiens
aagaagagcccggagcc

SEQ ID NO: 10347 - DNA, 17 bp, Homo sapiens
agaagagcccggagccc

SEQ ID NO: 10348 - DNA, 17 bp, Homo sapiens
gaagagcccggagccca

SEQ ID NO: 10349 - DNA, 17 bp, Homo sapiens
aagagcccggagcccaa

SEQ ID NO: 10350 - DNA, 17 bp, Homo sapiens
agagcccggagcccaag

SEQ ID NO: 10351 - DNA, 17 bp, Homo sapiens
gagcccggagcccaagg

SEQ ID NO: 10352 - DNA, 17 bp, Homo sapiens
agcccggagcccaagga

SEQ ID NO: 10353 - DNA, 17 bp, Homo sapiens
gcccggagcccaaggag

SEQ ID NO: 10354 - DNA, 17 bp, Homo sapiens
cccggagcccaaggagg

SEQ ID NO: 10355 - DNA, 17 bp, Homo sapiens
ccggagcccaaggagga

SEQ ID NO: 10356 - DNA, 17 bp, Homo sapiens
cggagcccaaggaggat

SEQ ID NO: 10357 - DNA, 17 bp, Homo sapiens
ggagcccaaggaggatc

SEQ ID NO: 10358 - DNA, 17 bp, Homo sapiens
gagcccaaggaggatcc

SEQ ID NO: 10359 - DNA, 17 bp, Homo sapiens
agcccaaggaggatccc

SEQ ID NO: 10360 - DNA, 17 bp, Homo sapiens
gcccaaggaggatcccg

SEQ ID NO: 10361 - DNA, 17 bp, Homo sapiens
cccaaggaggatcccgc

SEQ ID NO: 10362 - DNA, 17 bp, Homo sapiens
ccaaggaggatcccgct

SEQ ID NO: 10363 - DNA, 17 bp, Homo sapiens
caaggaggatcccgctc

SEQ ID NO: 10364 - DNA, 17 bp, Homo sapiens
aaggaggatcccgctca

SEQ ID NO: 10365 - DNA, 17 bp, Homo sapiens
aggaggatcccgctcac

SEQ ID NO: 10366 - DNA, 17 bp, Homo sapiens
ggaggatcccgctcacc

SEQ ID NO: 10367 - DNA, 17 bp, Homo sapiens
gaggatcccgctcacct

SEQ ID NO: 10368 - DNA, 17 bp, Homo sapiens
aggatcccgctcacctg

SEQ ID NO: 10369 - DNA, 17 bp, Homo sapiens
ggatcccgctcacctgt

SEQ ID NO: 10370 - DNA, 17 bp, Homo sapiens
gatcccgctcacctgtc

SEQ ID NO: 10371 - DNA, 17 bp, Homo sapiens
atcccgctcacctgtct

SEQ ID NO: 10372 - DNA, 17 bp, Homo sapiens
tcccgctcacctgtctg

SEQ ID NO: 10373 - DNA, 17 bp, Homo sapiens
cccgctcacctgtctga

SEQ ID NO: 10374 - DNA, 17 bp, Homo sapiens
ccgctcacctgtctgac

SEQ ID NO: 10375 - DNA, 17 bp, Homo sapiens
cgctcacctgtctgact

SEQ ID NO: 10376 - DNA, 17 bp, Homo sapiens
gctcacctgtctgactc

SEQ ID NO: 10377 - DNA, 17 bp, Homo sapiens
ctcacctgtctgactcg

SEQ ID NO: 10378 - DNA, 17 bp, Homo sapiens
tcacctgtctgactcgt

SEQ ID NO: 10379 - DNA, 17 bp, Homo sapiens
cacctgtctgactcgtc

SEQ ID NO: 10380 - DNA, 17 bp, Homo sapiens
acctgtctgactcgtcc

SEQ ID NO: 10381 - DNA, 17 bp, Homo sapiens
cctgtctgactcgtcct

SEQ ID NO: 10382 - DNA, 17 bp, Homo sapiens
ctgtctgactcgtcctc

SEQ ID NO: 10383 - DNA, 17 bp, Homo sapiens
tgtctgactcgtcctca

SEQ ID NO: 10384 - DNA, 17 bp, Homo sapiens
gtctgactcgtcctcat

SEQ ID NO: 10385 - DNA, 17 bp, Homo sapiens
tctgactcgtcctcatc

SEQ ID NO: 10386 - DNA, 17 bp, Homo sapiens
ctgactcgtcctcatcc

SEQ ID NO: 10387 - DNA, 17 bp, Homo sapiens
tgactcgtcctcatcct

SEQ ID NO: 10388 - DNA, 17 bp, Homo sapiens
gactcgtcctcatcctc

SEQ ID NO: 10389 - DNA, 17 bp, Homo sapiens
actcgtcctcatcctcc

SEQ ID NO: 10390 - DNA, 17 bp, Homo sapiens
ctcgtcctcatcctccg

SEQ ID NO: 10391 - DNA, 17 bp, Homo sapiens
tcgtcctcatcctccgg

SEQ ID NO: 10392 - DNA, 17 bp, Homo sapiens
cgtcctcatcctccggc

SEQ ID NO: 10393 - DNA, 17 bp, Homo sapiens
gtcctcatcctccggct

SEQ ID NO: 10394 - DNA, 17 bp, Homo sapiens
tcctcatcctccggctc

SEQ ID NO: 10395 - DNA, 17 bp, Homo sapiens
cctcatcctccggctcc

SEQ ID NO: 10396 - DNA, 17 bp, Homo sapiens
ctcatcctccggctcca

SEQ ID NO: 10397 - DNA, 17 bp, Homo sapiens
tcatcctccggctccat

SEQ ID NO: 10398 - DNA, 17 bp, Homo sapiens
catcctccggctccatc

SEQ ID NO: 10399 - DNA, 17 bp, Homo sapiens
atcctccggctccatcg

SEQ ID NO: 10400 - DNA, 17 bp, Homo sapiens
tcctccggctccatcgt

SEQ ID NO: 10401 - DNA, 17 bp, Homo sapiens
cctccggctccatcgtg

SEQ ID NO: 10402 - DNA, 17 bp, Homo sapiens
ctccggctccatcgtgt

SEQ ID NO: 10403 - DNA, 17 bp, Homo sapiens
tccggctccatcgtgtc

SEQ ID NO: 10404 - DNA, 17 bp, Homo sapiens
ccggctccatcgtgtcc

SEQ ID NO: 10405 - DNA, 17 bp, Homo sapiens
cggctccatcgtgtcct

SEQ ID NO: 10406 - DNA, 17 bp, Homo sapiens
ggctccatcgtgtcctt

SEQ ID NO: 10407 - DNA, 17 bp, Homo sapiens
gctccatcgtgtccttc

SEQ ID NO: 10408 - DNA, 17 bp, Homo sapiens
ctccatcgtgtccttca

SEQ ID NO: 10409 - DNA, 17 bp, Homo sapiens
tccatcgtgtccttcaa

SEQ ID NO: 10410 - DNA, 17 bp, Homo sapiens
ccatcgtgtccttcaaa

SEQ ID NO: 10411 - DNA, 17 bp, Homo sapiens
catcgtgtccttcaaaa

SEQ ID NO: 10412 - DNA, 17 bp, Homo sapiens
atcgtgtccttcaaaag

SEQ ID NO: 10413 - DNA, 17 bp, Homo sapiens
tcgtgtccttcaaaagt

SEQ ID NO: 10414 - DNA, 17 bp, Homo sapiens
cgtgtccttcaaaagtg

SEQ ID NO: 10415 - DNA, 17 bp, Homo sapiens
gtgtccttcaaaagtgc

SEQ ID NO: 10416 - DNA, 17 bp, Homo sapiens
tgtccttcaaaagtgct

SEQ ID NO: 10417 - DNA, 17 bp, Homo sapiens
gtccttcaaaagtgctg

SEQ ID NO: 10418 - DNA, 17 bp, Homo sapiens
tccttcaaaagtgctga

SEQ ID NO: 10419 - DNA, 17 bp, Homo sapiens
ccttcaaaagtgctgac

SEQ ID NO: 10420 - DNA, 17 bp, Homo sapiens
cttcaaaagtgctgaca

SEQ ID NO: 10421 - DNA, 17 bp, Homo sapiens
ttcaaaagtgctgacag

SEQ ID NO: 10422 - DNA, 17 bp, Homo sapiens
tcaaaagtgctgacagc

SEQ ID NO: 10423 - DNA, 17 bp, Homo sapiens
caaaagtgctgacagca

SEQ ID NO: 10424 - DNA, 17 bp, Homo sapiens
aaaagtgctgacagcat

SEQ ID NO: 10425 - DNA, 17 bp, Homo sapiens
aaagtgctgacagcatc

SEQ ID NO: 10426 - DNA, 17 bp, Homo sapiens
aagtgctgacagcatca

SEQ ID NO: 10427 - DNA, 17 bp, Homo sapiens
agtgctgacagcatcaa

SEQ ID NO: 10428 - DNA, 17 bp, Homo sapiens
gtgctgacagcatcaaa

SEQ ID NO: 10429 - DNA, 17 bp, Homo sapiens
tgctgacagcatcaaaa

SEQ ID NO: 10430 - DNA, 17 bp, Homo sapiens
gctgacagcatcaaaag

SEQ ID NO: 10431 - DNA, 17 bp, Homo sapiens
ctgacagcatcaaaagt

SEQ ID NO: 10432 - DNA, 17 bp, Homo sapiens
tgacagcatcaaaagtc

SEQ ID NO: 10433 - DNA, 17 bp, Homo sapiens
gacagcatcaaaagtcg

SEQ ID NO: 10434 - DNA, 17 bp, Homo sapiens
acagcatcaaaagtcga

SEQ ID NO: 10435 - DNA, 17 bp, Homo sapiens
cagcatcaaaagtcgac

SEQ ID NO: 10436 - DNA, 17 bp, Homo sapiens
agcatcaaaagtcgacc

SEQ ID NO: 10437 - DNA, 17 bp, Homo sapiens
gcatcaaaagtcgacca

SEQ ID NO: 10438 - DNA, 17 bp, Homo sapiens
catcaaaagtcgaccag

SEQ ID NO: 10439 - DNA, 17 bp, Homo sapiens
atcaaaagtcgaccagg

SEQ ID NO: 10440 - DNA, 17 bp, Homo sapiens
tcaaaagtcgaccagga

SEQ ID NO: 10441 - DNA, 17 bp, Homo sapiens
caaaagtcgaccaggaa

SEQ ID NO: 10442 - DNA, 17 bp, Homo sapiens
aaaagtcgaccaggaat

SEQ ID NO: 10443 - DNA, 17 bp, Homo sapiens
aaagtcgaccaggaatc

SEQ ID NO: 10444 - DNA, 17 bp, Homo sapiens
aagtcgaccaggaatcc

SEQ ID NO: 10445 - DNA, 17 bp, Homo sapiens
agtcgaccaggaatccc

SEQ ID NO: 10446 - DNA, 17 bp, Homo sapiens
gtcgaccaggaatccca

SEQ ID NO: 10447 - DNA, 17 bp, Homo sapiens
tcgaccaggaatcccac

SEQ ID NO: 10448 - DNA, 17 bp, Homo sapiens
cgaccaggaatcccacg

SEQ ID NO: 10449 - DNA, 17 bp, Homo sapiens
gaccaggaatcccacga

SEQ ID NO: 10450 - DNA, 17 bp, Homo sapiens
accaggaatcccacgac

SEQ ID NO: 10451 - DNA, 17 bp, Homo sapiens
ccaggaatcccacgact

SEQ ID NO: 10452 - DNA, 17 bp, Homo sapiens
caggaatcccacgactt

SEQ ID NO: 10453 - DNA, 17 bp, Homo sapiens
aggaatcccacgacttg

SEQ ID NO: 10454 - DNA, 17 bp, Homo sapiens
ggaatcccacgacttgc

SEQ ID NO: 10455 - DNA, 17 bp, Homo sapiens
gaatcccacgacttgcg

SEQ ID NO: 10456 - DNA, 17 bp, Homo sapiens
aatcccacgacttgcgg

SEQ ID NO: 10457 - DNA, 17 bp, Homo sapiens
atcccacgacttgcggg

SEQ ID NO: 10458 - DNA, 17 bp, Homo sapiens
tcccacgacttgcgggt

SEQ ID NO: 10459 - DNA, 17 bp, Homo sapiens
cccacgacttgcgggtg

SEQ ID NO: 10460 - DNA, 17 bp, Homo sapiens
ccacgacttgcgggtga

SEQ ID NO: 10461 - DNA, 17 bp, Homo sapiens
cacgacttgcgggtgac

SEQ ID NO: 10462 - DNA, 17 bp, Homo sapiens
acgacttgcgggtgacg

SEQ ID NO: 10463 - DNA, 17 bp, Homo sapiens
cgacttgcgggtgacgg

SEQ ID NO: 10464 - DNA, 17 bp, Homo sapiens
gacttgcgggtgacggt

SEQ ID NO: 10465 - DNA, 17 bp, Homo sapiens
acttgcgggtgacggtg

SEQ ID NO: 10466 - DNA, 17 bp, Homo sapiens
cttgcgggtgacggtgg

SEQ ID NO: 10467 - DNA, 17 bp, Homo sapiens
ttgcgggtgacggtggc

SEQ ID NO: 10468 - DNA, 17 bp, Homo sapiens
tgcgggtgacggtggcg

SEQ ID NO: 10469 - DNA, 17 bp, Homo sapiens
gcgggtgacggtggcga

SEQ ID NO: 10470 - DNA, 17 bp, Homo sapiens
cgggtgacggtggcgag

SEQ ID NO: 10471 - DNA, 17 bp, Homo sapiens
gggtgacggtggcgagc

SEQ ID NO: 10472 - DNA, 17 bp, Homo sapiens
ggtgacggtggcgagcg

SEQ ID NO: 10473 - DNA, 17 bp, Homo sapiens
gtgacggtggcgagcga

SEQ ID NO: 10474 - DNA, 17 bp, Homo sapiens
tgacggtggcgagcgaa

SEQ ID NO: 10475 - DNA, 17 bp, Homo sapiens
gacggtggcgagcgaac

SEQ ID NO: 10476 - DNA, 17 bp, Homo sapiens
acggtggcgagcgaacg

SEQ ID NO: 10477 - DNA, 17 bp, Homo sapiens
cggtggcgagcgaacgt

SEQ ID NO: 10478 - DNA, 17 bp, Homo sapiens
ggtggcgagcgaacgtc

SEQ ID NO: 10479 - DNA, 17 bp, Homo sapiens
gtggcgagcgaacgtcc

SEQ ID NO: 10480 - DNA, 17 bp, Homo sapiens
tggcgagcgaacgtccc

SEQ ID NO: 10481 - DNA, 17 bp, Homo sapiens
ggcgagcgaacgtcccc

SEQ ID NO: 10482 - DNA, 17 bp, Homo sapiens
gcgagcgaacgtccccc

SEQ ID NO: 10483 - DNA, 17 bp, Homo sapiens
cgagcgaacgtcccccg

SEQ ID NO: 10484 - DNA, 17 bp, Homo sapiens
gagcgaacgtcccccga

SEQ ID NO: 10485 - DNA, 17 bp, Homo sapiens
agcgaacgtcccccgag

SEQ ID NO: 10486 - DNA, 17 bp, Homo sapiens
gcgaacgtcccccgagc

SEQ ID NO: 10487 - DNA, 17 bp, Homo sapiens
cgaacgtcccccgagcg

SEQ ID NO: 10488 - DNA, 17 bp, Homo sapiens
gaacgtcccccgagcgg

SEQ ID NO: 10489 - DNA, 17 bp, Homo sapiens
aacgtcccccgagcgga

SEQ ID NO: 10490 - DNA, 17 bp, Homo sapiens
acgtcccccgagcggag

SEQ ID NO: 10491 - DNA, 17 bp, Homo sapiens
cgtcccccgagcggaga

SEQ ID NO: 10492 - DNA, 17 bp, Homo sapiens
gtcccccgagcggagag

SEQ ID NO: 10493 - DNA, 17 bp, Homo sapiens
tcccccgagcggagaga

SEQ ID NO: 10494 - DNA, 17 bp, Homo sapiens
cccccgagcggagagag

SEQ ID NO: 10495 - DNA, 17 bp, Homo sapiens
ccccgagcggagagagc

SEQ ID NO: 10496 - DNA, 17 bp, Homo sapiens
cccgagcggagagagcc

SEQ ID NO: 10497 - DNA, 17 bp, Homo sapiens
ccgagcggagagagcca

SEQ ID NO: 10498 - DNA, 17 bp, Homo sapiens
cgagcggagagagccag

SEQ ID NO: 10499 - DNA, 17 bp, Homo sapiens
gagcggagagagccagg

SEQ ID NO: 10500 - DNA, 17 bp, Homo sapiens
agcggagagagccaggg

SEQ ID NO: 10501 - DNA, 17 bp, Homo sapiens
gcggagagagccaggga

SEQ ID NO: 10502 - DNA, 17 bp, Homo sapiens
cggagagagccagggac

SEQ ID NO: 10503 - DNA, 17 bp, Homo sapiens
ggagagagccagggacg

SEQ ID NO: 10504 - DNA, 17 bp, Homo sapiens
gagagagccagggacgg

SEQ ID NO: 10505 - DNA, 17 bp, Homo sapiens
agagagccagggacggg

SEQ ID NO: 10506 - DNA, 17 bp, Homo sapiens
gagagccagggacgggg

SEQ ID NO: 10507 - DNA, 17 bp, Homo sapiens
agagccagggacgggga

SEQ ID NO: 10508 - DNA, 17 bp, Homo sapiens
gagccagggacggggag

SEQ ID NO: 10509 - DNA, 17 bp, Homo sapiens
agccagggacggggagg

SEQ ID NO: 10510 - DNA, 17 bp, Homo sapiens
gccagggacggggagga

SEQ ID NO: 10511 - DNA, 17 bp, Homo sapiens
ccagggacggggaggaa

SEQ ID NO: 10512 - DNA, 17 bp, Homo sapiens
cagggacggggaggaaa

SEQ ID NO: 10513 - DNA, 17 bp, Homo sapiens
agggacggggaggaaag

SEQ ID NO: 10514 - DNA, 17 bp, Homo sapiens
gggacggggaggaaaga

SEQ ID NO: 10515 - DNA, 17 bp, Homo sapiens
ggacggggaggaaagac

SEQ ID NO: 10516 - DNA, 17 bp, Homo sapiens
gacggggaggaaagacg

SEQ ID NO: 10517 - DNA, 17 bp, Homo sapiens
acggggaggaaagacga

SEQ ID NO: 10518 - DNA, 17 bp, Homo sapiens
cggggaggaaagacgac

SEQ ID NO: 10519 - DNA, 17 bp, Homo sapiens
ggggaggaaagacgacg

SEQ ID NO: 10520 - DNA, 17 bp, Homo sapiens
gggaggaaagacgacga

SEQ ID NO: 10521 - DNA, 17 bp, Homo sapiens
ggaggaaagacgacgat

SEQ ID NO: 10522 - DNA, 17 bp, Homo sapiens
gaggaaagacgacgatg

SEQ ID NO: 10523 - DNA, 17 bp, Homo sapiens
aggaaagacgacgatgt

SEQ ID NO: 10524 - DNA, 17 bp, Homo sapiens
ggaaagacgacgatgtt

SEQ ID NO: 10525 - DNA, 17 bp, Homo sapiens
gaaagacgacgatgttg

SEQ ID NO: 10526 - DNA, 17 bp, Homo sapiens
aaagacgacgatgttgc

SEQ ID NO: 10527 - DNA, 17 bp, Homo sapiens
aagacgacgatgttgcg

SEQ ID NO: 10528 - DNA, 17 bp, Homo sapiens
agacgacgatgttgcga

SEQ ID NO: 10529 - DNA, 17 bp, Homo sapiens
gacgacgatgttgcgag

SEQ ID NO: 10530 - DNA, 17 bp, Homo sapiens
acgacgatgttgcgagc

SEQ ID NO: 10531 - DNA, 17 bp, Homo sapiens
cgacgatgttgcgagca

SEQ ID NO: 10532 - DNA, 17 bp, Homo sapiens
gacgatgttgcgagcat

SEQ ID NO: 10533 - DNA, 17 bp, Homo sapiens
acgatgttgcgagcata

SEQ ID NO: 10534 - DNA, 17 bp, Homo sapiens
cgatgttgcgagcataa

SEQ ID NO: 10535 - DNA, 17 bp, Homo sapiens
gatgttgcgagcataat

SEQ ID NO: 10536 - DNA, 17 bp, Homo sapiens
atgttgcgagcataatg

SEQ ID NO: 10537 - DNA, 17 bp, Homo sapiens
tgttgcgagcataatga

SEQ ID NO: 10538 - DNA, 17 bp, Homo sapiens
gttgcgagcataatgaa

SEQ ID NO: 10539 - DNA, 17 bp, Homo sapiens
ttgcgagcataatgaag

SEQ ID NO: 10540 - DNA, 17 bp, Homo sapiens
tgcgagcataatgaaga

SEQ ID NO: 10541 - DNA, 17 bp, Homo sapiens
gcgagcataatgaagaa

SEQ ID NO: 10542 - DNA, 17 bp, Homo sapiens
cgagcataatgaagaaa

SEQ ID NO: 10543 - DNA, 17 bp, Homo sapiens
gagcataatgaagaaat

SEQ ID NO: 10544 - DNA, 17 bp, Homo sapiens
agcataatgaagaaata

SEQ ID NO: 10545 - DNA, 17 bp, Homo sapiens
gcataatgaagaaatac

SEQ ID NO: 10546 - DNA, 17 bp, Homo sapiens
cataatgaagaaatacc

SEQ ID NO: 10547 - DNA, 17 bp, Homo sapiens
ataatgaagaaatacct

SEQ ID NO: 10548 - DNA, 17 bp, Homo sapiens
taatgaagaaatacctc

SEQ ID NO: 10549 - DNA, 17 bp, Homo sapiens
aatgaagaaatacctcc

SEQ ID NO: 10550 - DNA, 17 bp, Homo sapiens
atgaagaaatacctcca

SEQ ID NO: 10551 - DNA, 17 bp, Homo sapiens
tgaagaaatacctccag

SEQ ID NO: 10552 - DNA, 17 bp, Homo sapiens
gaagaaatacctccaga

SEQ ID NO: 10553 - DNA, 17 bp, Homo sapiens
aagaaatacctccagaa

SEQ ID NO: 10554 - DNA, 17 bp, Homo sapiens
agaaatacctccagaag

SEQ ID NO: 10555 - DNA, 17 bp, Homo sapiens
gaaatacctccagaagt

SEQ ID NO: 10556 - DNA, 17 bp, Homo sapiens
aaatacctccagaagta

SEQ ID NO: 10557 - DNA, 17 bp, Homo sapiens
aatacctccagaagtag

SEQ ID NO: 10558 - DNA, 17 bp, Homo sapiens
atacctccagaagtagg

SEQ ID NO: 10559 - DNA, 17 bp, Homo sapiens
tacctccagaagtagga

SEQ ID NO: 10560 - DNA, 17 bp, Homo sapiens
acctccagaagtaggaa

SEQ ID NO: 10561 - DNA, 17 bp, Homo sapiens
cctccagaagtaggaac

SEQ ID NO: 10562 - DNA, 17 bp, Homo sapiens
ctccagaagtaggaacc

SEQ ID NO: 10563 - DNA, 17 bp, Homo sapiens
tccagaagtaggaacca

SEQ ID NO: 10564 - DNA, 17 bp, Homo sapiens
ccagaagtaggaaccag

SEQ ID NO: 10565 - DNA, 17 bp, Homo sapiens
cagaagtaggaaccagt

SEQ ID NO: 10566 - DNA, 17 bp, Homo sapiens
agaagtaggaaccagtt

SEQ ID NO: 10567 - DNA, 17 bp, Homo sapiens
gaagtaggaaccagttc

SEQ ID NO: 10568 - DNA, 17 bp, Homo sapiens
aagtaggaaccagttca

SEQ ID NO: 10569 - DNA, 17 bp, Homo sapiens
agtaggaaccagttcag

SEQ ID NO: 10570 - DNA, 17 bp, Homo sapiens
gtaggaaccagttcagc

SEQ ID NO: 10571 - DNA, 17 bp, Homo sapiens
taggaaccagttcagcc

SEQ ID NO: 10572 - DNA, 17 bp, Homo sapiens
aggaaccagttcagcct

SEQ ID NO: 10573 - DNA, 17 bp, Homo sapiens
ggaaccagttcagcctc

SEQ ID NO: 10574 - DNA, 17 bp, Homo sapiens
gaaccagttcagcctcc

SEQ ID NO: 10575 - DNA, 17 bp, Homo sapiens
aaccagttcagcctcct

SEQ ID NO: 10576 - DNA, 17 bp, Homo sapiens
accagttcagcctcctt

SEQ ID NO: 10577 - DNA, 17 bp, Homo sapiens
ccagttcagcctccttg

SEQ ID NO: 10578 - DNA, 17 bp, Homo sapiens
cagttcagcctccttga

SEQ ID NO: 10579 - DNA, 17 bp, Homo sapiens
agttcagcctccttgaa

SEQ ID NO: 10580 - DNA, 17 bp, Homo sapiens
gttcagcctccttgaag

SEQ ID NO: 10581 - DNA, 17 bp, Homo sapiens
ttcagcctccttgaagc

SEQ ID NO: 10582 - DNA, 17 bp, Homo sapiens
tcagcctccttgaagct

SEQ ID NO: 10583 - DNA, 17 bp, Homo sapiens
cagcctccttgaagctg

SEQ ID NO: 10584 - DNA, 17 bp, Homo sapiens
agcctccttgaagctgc

SEQ ID NO: 10585 - DNA, 17 bp, Homo sapiens
gcctccttgaagctgcc

SEQ ID NO: 10586 - DNA, 17 bp, Homo sapiens
cctccttgaagctgccc

SEQ ID NO: 10587 - DNA, 17 bp, Homo sapiens
ctccttgaagctgccct

SEQ ID NO: 10588 - DNA, 17 bp, Homo sapiens
tccttgaagctgccctt

SEQ ID NO: 10589 - DNA, 17 bp, Homo sapiens
ccttgaagctgcccttg

SEQ ID NO: 10590 - DNA, 17 bp, Homo sapiens
cttgaagctgcccttga

SEQ ID NO: 10591 - DNA, 17 bp, Homo sapiens
ttgaagctgcccttgaa

SEQ ID NO: 10592 - DNA, 17 bp, Homo sapiens
tgaagctgcccttgaag

SEQ ID NO: 10593 - DNA, 17 bp, Homo sapiens
gaagctgcccttgaaga

SEQ ID NO: 10594 - DNA, 17 bp, Homo sapiens
aagctgcccttgaagac

SEQ ID NO: 10595 - DNA, 17 bp, Homo sapiens
agctgcccttgaagact

SEQ ID NO: 10596 - DNA, 17 bp, Homo sapiens
gctgcccttgaagactt

SEQ ID NO: 10597 - DNA, 17 bp, Homo sapiens
ctgcccttgaagacttc

SEQ ID NO: 10598 - DNA, 17 bp, Homo sapiens
tgcccttgaagacttcc

SEQ ID NO: 10599 - DNA, 17 bp, Homo sapiens
gcccttgaagacttccc

SEQ ID NO: 10600 - DNA, 17 bp, Homo sapiens
cccttgaagacttcccg

SEQ ID NO: 10601 - DNA, 17 bp, Homo sapiens
ccttgaagacttcccga

SEQ ID NO: 10602 - DNA, 17 bp, Homo sapiens
cttgaagacttcccgac

SEQ ID NO: 10603 - DNA, 17 bp, Homo sapiens
ttgaagacttcccgact

SEQ ID NO: 10604 - DNA, 17 bp, Homo sapiens
tgaagacttcccgactc

SEQ ID NO: 10605 - DNA, 17 bp, Homo sapiens
gaagacttcccgactct

SEQ ID NO: 10606 - DNA, 17 bp, Homo sapiens
aagacttcccgactcta

SEQ ID NO: 10607 - DNA, 17 bp, Homo sapiens
agacttcccgactctac

SEQ ID NO: 10608 - DNA, 17 bp, Homo sapiens
gacttcccgactctaca

SEQ ID NO: 10609 - DNA, 17 bp, Homo sapiens
acttcccgactctacaa

SEQ ID NO: 10610 - DNA, 17 bp, Homo sapiens
cttcccgactctacaat

SEQ ID NO: 10611 - DNA, 17 bp, Homo sapiens
ttcccgactctacaata

SEQ ID NO: 10612 - DNA, 17 bp, Homo sapiens
tcccgactctacaataa

SEQ ID NO: 10613 - DNA, 17 bp, Homo sapiens
cccgactctacaataac

SEQ ID NO: 10614 - DNA, 17 bp, Homo sapiens
ccgactctacaataact

SEQ ID NO: 10615 - DNA, 17 bp, Homo sapiens
cgactctacaataactt

SEQ ID NO: 10616 - DNA, 17 bp, Homo sapiens
gactctacaataacttg

SEQ ID NO: 10617 - DNA, 17 bp, Homo sapiens
actctacaataacttgg

SEQ ID NO: 10618 - DNA, 17 bp, Homo sapiens
ctctacaataacttgga

SEQ ID NO: 10619 - DNA, 17 bp, Homo sapiens
tctacaataacttggag

SEQ ID NO: 10620 - DNA, 17 bp, Homo sapiens
ctacaataacttggaga

SEQ ID NO: 10621 - DNA, 17 bp, Homo sapiens
tacaataacttggagac

SEQ ID NO: 10622 - DNA, 17 bp, Homo sapiens
acaataacttggagaca

SEQ ID NO: 10623 - DNA, 17 bp, Homo sapiens
caataacttggagacag

SEQ ID NO: 10624 - DNA, 17 bp, Homo sapiens
aataacttggagacaga

SEQ ID NO: 10625 - DNA, 17 bp, Homo sapiens
ataacttggagacagag

SEQ ID NO: 10626 - DNA, 17 bp, Homo sapiens
taacttggagacagaga

SEQ ID NO: 10627 - DNA, 17 bp, Homo sapiens
aacttggagacagagag

SEQ ID NO: 10628 - DNA, 17 bp, Homo sapiens
acttggagacagagaga

SEQ ID NO: 10629 - DNA, 17 bp, Homo sapiens
cttggagacagagagac

SEQ ID NO: 10630 - DNA, 17 bp, Homo sapiens
ttggagacagagagact

SEQ ID NO: 10631 - DNA, 17 bp, Homo sapiens
tggagacagagagactg

SEQ ID NO: 10632 - DNA, 17 bp, Homo sapiens
ggagacagagagactgg

SEQ ID NO: 10633 - DNA, 17 bp, Homo sapiens
gagacagagagactggc

SEQ ID NO: 10634 - DNA, 17 bp, Homo sapiens
agacagagagactggcc

SEQ ID NO: 10635 - DNA, 17 bp, Homo sapiens
gacagagagactggcca

SEQ ID NO: 10636 - DNA, 17 bp, Homo sapiens
acagagagactggccag

SEQ ID NO: 10637 - DNA, 17 bp, Homo sapiens
cagagagactggccagg

SEQ ID NO: 10638 - DNA, 17 bp, Homo sapiens
agagagactggccaggc

SEQ ID NO: 10639 - DNA, 17 bp, Homo sapiens
gagagactggccaggcc

SEQ ID NO: 10640 - DNA, 17 bp, Homo sapiens
agagactggccaggcct

SEQ ID NO: 10641 - DNA, 17 bp, Homo sapiens
gagactggccaggcctc

SEQ ID NO: 10642 - DNA, 17 bp, Homo sapiens
agactggccaggcctcc

SEQ ID NO: 10643 - DNA, 17 bp, Homo sapiens
gactggccaggcctccc

SEQ ID NO: 10644 - DNA, 17 bp, Homo sapiens
actggccaggcctcccc

SEQ ID NO: 10645 - DNA, 17 bp, Homo sapiens
ctggccaggcctccccg

SEQ ID NO: 10646 - DNA, 17 bp, Homo sapiens
tggccaggcctccccgg

SEQ ID NO: 10647 - DNA, 17 bp, Homo sapiens
ggccaggcctccccggt

SEQ ID NO: 10648 - DNA, 17 bp, Homo sapiens
gccaggcctccccggtg

SEQ ID NO: 10649 - DNA, 17 bp, Homo sapiens
ccaggcctccccggtgg

SEQ ID NO: 10650 - DNA, 17 bp, Homo sapiens
caggcctccccggtggc

SEQ ID NO: 10651 - DNA, 17 bp, Homo sapiens
aggcctccccggtggcc

SEQ ID NO: 10652 - DNA, 17 bp, Homo sapiens
ggcctccccggtggcca

SEQ ID NO: 10653 - DNA, 17 bp, Homo sapiens
gcctccccggtggccag

SEQ ID NO: 10654 - DNA, 17 bp, Homo sapiens
cctccccggtggccaga

SEQ ID NO: 10655 - DNA, 17 bp, Homo sapiens
ctccccggtggccagag

SEQ ID NO: 10656 - DNA, 17 bp, Homo sapiens
tccccggtggccagagc

SEQ ID NO: 10657 - DNA, 17 bp, Homo sapiens
ccccggtggccagagcc

SEQ ID NO: 10658 - DNA, 17 bp, Homo sapiens
cccggtggccagagcca

SEQ ID NO: 10659 - DNA, 17 bp, Homo sapiens
ccggtggccagagccag

SEQ ID NO: 10660 - DNA, 17 bp, Homo sapiens
cggtggccagagccagc

SEQ ID NO: 10661 - DNA, 17 bp, Homo sapiens
ggtggccagagccagcc

SEQ ID NO: 10662 - DNA, 17 bp, Homo sapiens
gtggccagagccagcca

SEQ ID NO: 10663 - DNA, 17 bp, Homo sapiens
tggccagagccagccag

SEQ ID NO: 10664 - DNA, 17 bp, Homo sapiens
ggccagagccagccagc

SEQ ID NO: 10665 - DNA, 17 bp, Homo sapiens
gccagagccagccagca

SEQ ID NO: 10666 - DNA, 17 bp, Homo sapiens
ccagagccagccagcat

SEQ ID NO: 10667 - DNA, 17 bp, Homo sapiens
cagagccagccagcatg

SEQ ID NO: 10668 - DNA, 17 bp, Homo sapiens
agagccagccagcatgg

SEQ ID NO: 10669 - DNA, 17 bp, Homo sapiens
gagccagccagcatggc

SEQ ID NO: 10670 - DNA, 17 bp, Homo sapiens
agccagccagcatggcc

SEQ ID NO: 10671 - DNA, 17 bp, Homo sapiens
gccagccagcatggcca

SEQ ID NO: 10672 - DNA, 17 bp, Homo sapiens
ccagccagcatggccac

SEQ ID NO: 10673 - DNA, 17 bp, Homo sapiens
cagccagcatggccacc

SEQ ID NO: 10674 - DNA, 17 bp, Homo sapiens
agccagcatggccaccc

SEQ ID NO: 10675 - DNA, 17 bp, Homo sapiens
gccagcatggccaccct

SEQ ID NO: 10676 - DNA, 17 bp, Homo sapiens
ccagcatggccaccctc

SEQ ID NO: 10677 - DNA, 17 bp, Homo sapiens
cagcatggccaccctca

SEQ ID NO: 10678 - DNA, 17 bp, Homo sapiens
agcatggccaccctcaa

SEQ ID NO: 10679 - DNA, 17 bp, Homo sapiens
gcatggccaccctcaag

SEQ ID NO: 10680 - DNA, 17 bp, Homo sapiens
catggccaccctcaaga

SEQ ID NO: 10681 - DNA, 17 bp, Homo sapiens
atggccaccctcaagag

SEQ ID NO: 10682 - DNA, 17 bp, Homo sapiens
tggccaccctcaagagg

SEQ ID NO: 10683 - DNA, 17 bp, Homo sapiens
ggccaccctcaagaggc

SEQ ID NO: 10684 - DNA, 17 bp, Homo sapiens
gccaccctcaagaggcg

SEQ ID NO: 10685 - DNA, 17 bp, Homo sapiens
ccaccctcaagaggcga

SEQ ID NO: 10686 - DNA, 17 bp, Homo sapiens
caccctcaagaggcgag

SEQ ID NO: 10687 - DNA, 17 bp, Homo sapiens
accctcaagaggcgaga

SEQ ID NO: 10688 - DNA, 17 bp, Homo sapiens
ccctcaagaggcgagat

SEQ ID NO: 10689 - DNA, 17 bp, Homo sapiens
cctcaagaggcgagatg

SEQ ID NO: 10690 - DNA, 17 bp, Homo sapiens
ctcaagaggcgagatga

SEQ ID NO: 10691 - DNA, 17 bp, Homo sapiens
tcaagaggcgagatgag

SEQ ID NO: 10692 - DNA, 17 bp, Homo sapiens
caagaggcgagatgagc

SEQ ID NO: 10693 - DNA, 17 bp, Homo sapiens
aagaggcgagatgagcc

SEQ ID NO: 10694 - DNA, 17 bp, Homo sapiens
agaggcgagatgagccc

SEQ ID NO: 10695 - DNA, 17 bp, Homo sapiens
gaggcgagatgagccca

SEQ ID NO: 10696 - DNA, 17 bp, Homo sapiens
aggcgagatgagcccac

SEQ ID NO: 10697 - DNA, 17 bp, Homo sapiens
ggcgagatgagcccaca

SEQ ID NO: 10698 - DNA, 17 bp, Homo sapiens
gcgagatgagcccacag

SEQ ID NO: 10699 - DNA, 17 bp, Homo sapiens
cgagatgagcccacaga

SEQ ID NO: 10700 - DNA, 17 bp, Homo sapiens
gagatgagcccacagag

SEQ ID NO: 10701 - DNA, 17 bp, Homo sapiens
agatgagcccacagagg

SEQ ID NO: 10702 - DNA, 17 bp, Homo sapiens
gatgagcccacagaggc

SEQ ID NO: 10703 - DNA, 17 bp, Homo sapiens
atgagcccacagaggca

SEQ ID NO: 10704 - DNA, 17 bp, Homo sapiens
tgagcccacagaggcat

SEQ ID NO: 10705 - DNA, 17 bp, Homo sapiens
gagcccacagaggcata

SEQ ID NO: 10706 - DNA, 17 bp, Homo sapiens
agcccacagaggcatat

SEQ ID NO: 10707 - DNA, 17 bp, Homo sapiens
gcccacagaggcatatc

SEQ ID NO: 10708 - DNA, 17 bp, Homo sapiens
cccacagaggcatatcc

SEQ ID NO: 10709 - DNA, 17 bp, Homo sapiens
ccacagaggcatatcct

SEQ ID NO: 10710 - DNA, 17 bp, Homo sapiens
cacagaggcatatcctg

SEQ ID NO: 10711 - DNA, 17 bp, Homo sapiens
acagaggcatatcctgc

SEQ ID NO: 10712 - DNA, 17 bp, Homo sapiens
cagaggcatatcctgcg

SEQ ID NO: 10713 - DNA, 17 bp, Homo sapiens
agaggcatatcctgcgg

SEQ ID NO: 10714 - DNA, 17 bp, Homo sapiens
gaggcatatcctgcggg

SEQ ID NO: 10715 - DNA, 17 bp, Homo sapiens
aggcatatcctgcgggg

SEQ ID NO: 10716 - DNA, 17 bp, Homo sapiens
ggcatatcctgcgggga

SEQ ID NO: 10717 - DNA, 17 bp, Homo sapiens
gcatatcctgcggggat

SEQ ID NO: 10718 - DNA, 17 bp, Homo sapiens
catatcctgcggggatg

SEQ ID NO: 10719 - DNA, 17 bp, Homo sapiens
atatcctgcggggatgc

SEQ ID NO: 10720 - DNA, 17 bp, Homo sapiens
tatcctgcggggatgct

SEQ ID NO: 10721 - DNA, 17 bp, Homo sapiens
atcctgcggggatgctg

SEQ ID NO: 10722 - DNA, 17 bp, Homo sapiens
tcctgcggggatgctgg

SEQ ID NO: 10723 - DNA, 17 bp, Homo sapiens
cctgcggggatgctggg

SEQ ID NO: 10724 - DNA, 17 bp, Homo sapiens
ctgcggggatgctgggc

SEQ ID NO: 10725 - DNA, 17 bp, Homo sapiens
tgcggggatgctgggct

SEQ ID NO: 10726 - DNA, 17 bp, Homo sapiens
gcggggatgctgggctc

SEQ ID NO: 10727 - DNA, 17 bp, Homo sapiens
cggggatgctgggctcc

SEQ ID NO: 10728 - DNA, 17 bp, Homo sapiens
ggggatgctgggctccc

SEQ ID NO: 10729 - DNA, 17 bp, Homo sapiens
gggatgctgggctccca

SEQ ID NO: 10730 - DNA, 17 bp, Homo sapiens
ggatgctgggctcccag

SEQ ID NO: 10731 - DNA, 17 bp, Homo sapiens
gatgctgggctcccagt

SEQ ID NO: 10732 - DNA, 17 bp, Homo sapiens
atgctgggctcccagtg

SEQ ID NO: 10733 - DNA, 17 bp, Homo sapiens
tgctgggctcccagtgt

SEQ ID NO: 10734 - DNA, 17 bp, Homo sapiens
gctgggctcccagtgtg

SEQ ID NO: 10735 - DNA, 17 bp, Homo sapiens
ctgggctcccagtgtgg

SEQ ID NO: 10736 - DNA, 17 bp, Homo sapiens
tgggctcccagtgtggt

SEQ ID NO: 10737 - DNA, 17 bp, Homo sapiens
gggctcccagtgtggtt

SEQ ID NO: 10738 - DNA, 17 bp, Homo sapiens
ggctcccagtgtggttg

SEQ ID NO: 10739 - DNA, 17 bp, Homo sapiens
gctcccagtgtggttgg

SEQ ID NO: 10740 - DNA, 17 bp, Homo sapiens
ctcccagtgtggttggc

SEQ ID NO: 10741 - DNA, 17 bp, Homo sapiens
tcccagtgtggttggcc

SEQ ID NO: 10742 - DNA, 17 bp, Homo sapiens
cccagtgtggttggcct

SEQ ID NO: 10743 - DNA, 17 bp, Homo sapiens
ccagtgtggttggcctg

SEQ ID NO: 10744 - DNA, 17 bp, Homo sapiens
cagtgtggttggcctga

SEQ ID NO: 10745 - DNA, 17 bp, Homo sapiens
agtgtggttggcctgaa

SEQ ID NO: 10746 - DNA, 17 bp, Homo sapiens
gtgtggttggcctgaac

SEQ ID NO: 10747 - DNA, 17 bp, Homo sapiens
tgtggttggcctgaaca

SEQ ID NO: 10748 - DNA, 17 bp, Homo sapiens
gtggttggcctgaacaa

SEQ ID NO: 10749 - DNA, 17 bp, Homo sapiens
tggttggcctgaacaaa

SEQ ID NO: 10750 - DNA, 17 bp, Homo sapiens
ggttggcctgaacaaaa

SEQ ID NO: 10751 - DNA, 17 bp, Homo sapiens
gttggcctgaacaaaat

SEQ ID NO: 10752 - DNA, 17 bp, Homo sapiens
ttggcctgaacaaaata

SEQ ID NO: 10753 - DNA, 17 bp, Homo sapiens
tggcctgaacaaaataa

SEQ ID NO: 10754 - DNA, 17 bp, Homo sapiens
ggcctgaacaaaataaa

SEQ ID NO: 10755 - DNA, 17 bp, Homo sapiens
gcctgaacaaaataaag

SEQ ID NO: 10756 - DNA, 17 bp, Homo sapiens
cctgaacaaaataaagt

SEQ ID NO: 10757 - DNA, 17 bp, Homo sapiens
ctgaacaaaataaagtg

SEQ ID NO: 10758 - DNA, 17 bp, Homo sapiens
tgaacaaaataaagtgt

SEQ ID NO: 10759 - DNA, 17 bp, Homo sapiens
gaacaaaataaagtgtt

SEQ ID NO: 10760 - DNA, 17 bp, Homo sapiens
aacaaaataaagtgttg

SEQ ID NO: 10761 - DNA, 17 bp, Homo sapiens
acaaaataaagtgttga

SEQ ID NO: 10762 - DNA, 17 bp, Homo sapiens
caaaataaagtgttgac

SEQ ID NO: 10763 - DNA, 17 bp, Homo sapiens
aaaataaagtgttgact

SEQ ID NO: 10764 - DNA, 17 bp, Homo sapiens
aaataaagtgttgactc

SEQ ID NO: 10765 - DNA, 17 bp, Homo sapiens
aataaagtgttgactcc

SEQ ID NO: 10766 - DNA, 17 bp, Homo sapiens
ataaagtgttgactcct

SEQ ID NO: 10767 - DNA, 17 bp, Homo sapiens
taaagtgttgactcctg

SEQ ID NO: 10768 - DNA, 17 bp, Homo sapiens
aaagtgttgactcctgg

SEQ ID NO: 10769 - DNA, 17 bp, Homo sapiens
aagtgttgactcctggg

SEQ ID NO: 10770 - DNA, 17 bp, Homo sapiens
agtgttgactcctgggc

SEQ ID NO: 10771 - DNA, 17 bp, Homo sapiens
gtgttgactcctgggca

SEQ ID NO: 10772 - DNA, 25 bp, Homo sapiens
cccggacccctccccagggaccacc

SEQ ID NO: 10773 - DNA, 25 bp, Homo sapiens
ccggacccctccccagggaccaccg

SEQ ID NO: 10774 - DNA, 25 bp, Homo sapiens
cggacccctccccagggaccaccgt

SEQ ID NO: 10775 - DNA, 25 bp, Homo sapiens
ggacccctccccagggaccaccgtg

SEQ ID NO: 10776 - DNA, 25 bp, Homo sapiens
gacccctccccagggaccaccgtgg

SEQ ID NO: 10777 - DNA, 25 bp, Homo sapiens
acccctccccagggaccaccgtggc

SEQ ID NO: 10778 - DNA, 25 bp, Homo sapiens
cccctccccagggaccaccgtggct

SEQ ID NO: 10779 - DNA, 25 bp, Homo sapiens
ccctccccagggaccaccgtggctg

SEQ ID NO: 10780 - DNA, 25 bp, Homo sapiens
cctccccagggaccaccgtggctgt

SEQ ID NO: 10781 - DNA, 25 bp, Homo sapiens
ctccccagggaccaccgtggctgtt

SEQ ID NO: 10782 - DNA, 25 bp, Homo sapiens
tccccagggaccaccgtggctgttg

SEQ ID NO: 10783 - DNA, 25 bp, Homo sapiens
ccccagggaccaccgtggctgttgt

SEQ ID NO: 10784 - DNA, 25 bp, Homo sapiens
cccagggaccaccgtggctgttgtg

SEQ ID NO: 10785 - DNA, 25 bp, Homo sapiens
ccagggaccaccgtggctgttgtgg

SEQ ID NO: 10786 - DNA, 25 bp, Homo sapiens
cagggaccaccgtggctgttgtgga

SEQ ID NO: 10787 - DNA, 25 bp, Homo sapiens
agggaccaccgtggctgttgtggat

SEQ ID NO: 10788 - DNA, 25 bp, Homo sapiens
gggaccaccgtggctgttgtggatc

SEQ ID NO: 10789 - DNA, 25 bp, Homo sapiens
ggaccaccgtggctgttgtggatca

SEQ ID NO: 10790 - DNA, 25 bp, Homo sapiens
gaccaccgtggctgttgtggatcaa

SEQ ID NO: 10791 - DNA, 25 bp, Homo sapiens
accaccgtggctgttgtggatcaaa

SEQ ID NO: 10792 - DNA, 25 bp, Homo sapiens
ccaccgtggctgttgtggatcaaaa

SEQ ID NO: 10793 - DNA, 25 bp, Homo sapiens
caccgtggctgttgtggatcaaaat

SEQ ID NO: 10794 - DNA, 25 bp, Homo sapiens
accgtggctgttgtggatcaaaatc

SEQ ID NO: 10795 - DNA, 25 bp, Homo sapiens
ccgtggctgttgtggatcaaaatcc

SEQ ID NO: 10796 - DNA, 25 bp, Homo sapiens
cgtggctgttgtggatcaaaatccc

SEQ ID NO: 10797 - DNA, 25 bp, Homo sapiens
gtggctgttgtggatcaaaatccct

SEQ ID NO: 10798 - DNA, 25 bp, Homo sapiens
tggctgttgtggatcaaaatccctc

SEQ ID NO: 10799 - DNA, 25 bp, Homo sapiens
ggctgttgtggatcaaaatccctct

SEQ ID NO: 10800 - DNA, 25 bp, Homo sapiens
gctgttgtggatcaaaatccctctc

SEQ ID NO: 10801 - DNA, 25 bp, Homo sapiens
ctgttgtggatcaaaatccctctca

SEQ ID NO: 10802 - DNA, 25 bp, Homo sapiens
tgttgtggatcaaaatccctctcag

SEQ ID NO: 10803 - DNA, 25 bp, Homo sapiens
gttgtggatcaaaatccctctcagc

SEQ ID NO: 10804 - DNA, 25 bp, Homo sapiens
ttgtggatcaaaatccctctcagca

SEQ ID NO: 10805 - DNA, 25 bp, Homo sapiens
tgtggatcaaaatccctctcagcag

SEQ ID NO: 10806 - DNA, 25 bp, Homo sapiens
gtggatcaaaatccctctcagcagg

SEQ ID NO: 10807 - DNA, 25 bp, Homo sapiens
tggatcaaaatccctctcagcaggt

SEQ ID NO: 10808 - DNA, 25 bp, Homo sapiens
ggatcaaaatccctctcagcaggtc

SEQ ID NO: 10809 - DNA, 25 bp, Homo sapiens
gatcaaaatccctctcagcaggtcc

SEQ ID NO: 10810 - DNA, 25 bp, Homo sapiens
atcaaaatccctctcagcaggtccg

SEQ ID NO: 10811 - DNA, 25 bp, Homo sapiens
tcaaaatccctctcagcaggtccgc

SEQ ID NO: 10812 - DNA, 25 bp, Homo sapiens
caaaatccctctcagcaggtccgct

SEQ ID NO: 10813 - DNA, 25 bp, Homo sapiens
aaaatccctctcagcaggtccgctt

SEQ ID NO: 10814 - DNA, 25 bp, Homo sapiens
aaatccctctcagcaggtccgctta

SEQ ID NO: 10815 - DNA, 25 bp, Homo sapiens
aatccctctcagcaggtccgcttac

SEQ ID NO: 10816 - DNA, 25 bp, Homo sapiens
atccctctcagcaggtccgcttacc

SEQ ID NO: 10817 - DNA, 25 bp, Homo sapiens
tccctctcagcaggtccgcttacca

SEQ ID NO: 10818 - DNA, 25 bp, Homo sapiens
ccctctcagcaggtccgcttaccag

SEQ ID NO: 10819 - DNA, 25 bp, Homo sapiens
cctctcagcaggtccgcttaccagc

SEQ ID NO: 10820 - DNA, 25 bp, Homo sapiens
ctctcagcaggtccgcttaccagct

SEQ ID NO: 10821 - DNA, 25 bp, Homo sapiens
tctcagcaggtccgcttaccagctg

SEQ ID NO: 10822 - DNA, 25 bp, Homo sapiens
ctcagcaggtccgcttaccagctgg

SEQ ID NO: 10823 - DNA, 25 bp, Homo sapiens
tcagcaggtccgcttaccagctgga

SEQ ID NO: 10824 - DNA, 25 bp, Homo sapiens
cagcaggtccgcttaccagctggag

SEQ ID NO: 10825 - DNA, 25 bp, Homo sapiens
agcaggtccgcttaccagctggagg

SEQ ID NO: 10826 - DNA, 25 bp, Homo sapiens
gcaggtccgcttaccagctggagga

SEQ ID NO: 10827 - DNA, 25 bp, Homo sapiens
caggtccgcttaccagctggaggag

SEQ ID NO: 10828 - DNA, 25 bp, Homo sapiens
aggtccgcttaccagctggaggagg

SEQ ID NO: 10829 - DNA, 25 bp, Homo sapiens
ggtccgcttaccagctggaggaggt

SEQ ID NO: 10830 - DNA, 25 bp, Homo sapiens
gtccgcttaccagctggaggaggtg

SEQ ID NO: 10831 - DNA, 25 bp, Homo sapiens
tccgcttaccagctggaggaggtgc

SEQ ID NO: 10832 - DNA, 25 bp, Homo sapiens
ccgcttaccagctggaggaggtgcc

SEQ ID NO: 10833 - DNA, 25 bp, Homo sapiens
cgcttaccagctggaggaggtgccc

SEQ ID NO: 10834 - DNA, 25 bp, Homo sapiens
gcttaccagctggaggaggtgccca

SEQ ID NO: 10835 - DNA, 25 bp, Homo sapiens
cttaccagctggaggaggtgcccag

SEQ ID NO: 10836 - DNA, 25 bp, Homo sapiens
ttaccagctggaggaggtgcccagg

SEQ ID NO: 10837 - DNA, 25 bp, Homo sapiens
taccagctggaggaggtgcccagga

SEQ ID NO: 10838 - DNA, 25 bp, Homo sapiens
accagctggaggaggtgcccaggat

SEQ ID NO: 10839 - DNA, 25 bp, Homo sapiens
ccagctggaggaggtgcccaggatg

SEQ ID NO: 10840 - DNA, 25 bp, Homo sapiens
cagctggaggaggtgcccaggatgc

SEQ ID NO: 10841 - DNA, 25 bp, Homo sapiens
agctggaggaggtgcccaggatgcc

SEQ ID NO: 10842 - DNA, 25 bp, Homo sapiens
gctggaggaggtgcccaggatgcca

SEQ ID NO: 10843 - DNA, 25 bp, Homo sapiens
ctggaggaggtgcccaggatgccag

SEQ ID NO: 10844 - DNA, 25 bp, Homo sapiens
tggaggaggtgcccaggatgccaga

SEQ ID NO: 10845 - DNA, 25 bp, Homo sapiens
ggaggaggtgcccaggatgccagag

SEQ ID NO: 10846 - DNA, 25 bp, Homo sapiens
gaggaggtgcccaggatgccagagg

SEQ ID NO: 10847 - DNA, 25 bp, Homo sapiens
aggaggtgcccaggatgccagaggc

SEQ ID NO: 10848 - DNA, 25 bp, Homo sapiens
ggaggtgcccaggatgccagaggcc

SEQ ID NO: 10849 - DNA, 25 bp, Homo sapiens
gaggtgcccaggatgccagaggcct

SEQ ID NO: 10850 - DNA, 25 bp, Homo sapiens
aggtgcccaggatgccagaggcctt

SEQ ID NO: 10851 - DNA, 25 bp, Homo sapiens
ggtgcccaggatgccagaggccttt

SEQ ID NO: 10852 - DNA, 25 bp, Homo sapiens
gtgcccaggatgccagaggcctttt

SEQ ID NO: 10853 - DNA, 25 bp, Homo sapiens
tgcccaggatgccagaggccttttc

SEQ ID NO: 10854 - DNA, 25 bp, Homo sapiens
gcccaggatgccagaggccttttct

SEQ ID NO: 10855 - DNA, 25 bp, Homo sapiens
cccaggatgccagaggccttttctg

SEQ ID NO: 10856 - DNA, 25 bp, Homo sapiens
ccaggatgccagaggccttttctgg

SEQ ID NO: 10857 - DNA, 25 bp, Homo sapiens
caggatgccagaggccttttctggg

SEQ ID NO: 10858 - DNA, 25 bp, Homo sapiens
aggatgccagaggccttttctgggt

SEQ ID NO: 10859 - DNA, 25 bp, Homo sapiens
ggatgccagaggccttttctgggtc

SEQ ID NO: 10860 - DNA, 25 bp, Homo sapiens
gatgccagaggccttttctgggtct

SEQ ID NO: 10861 - DNA, 25 bp, Homo sapiens
atgccagaggccttttctgggtctt

SEQ ID NO: 10862 - DNA, 25 bp, Homo sapiens
tgccagaggccttttctgggtctta

SEQ ID NO: 10863 - DNA, 25 bp, Homo sapiens
gccagaggccttttctgggtcttag

SEQ ID NO: 10864 - DNA, 25 bp, Homo sapiens
ccagaggccttttctgggtcttaga

SEQ ID NO: 10865 - DNA, 25 bp, Homo sapiens
cagaggccttttctgggtcttagat

SEQ ID NO: 10866 - DNA, 25 bp, Homo sapiens
agaggccttttctgggtcttagatg

SEQ ID NO: 10867 - DNA, 25 bp, Homo sapiens
gaggccttttctgggtcttagatga

SEQ ID NO: 10868 - DNA, 25 bp, Homo sapiens
aggccttttctgggtcttagatgag

SEQ ID NO: 10869 - DNA, 25 bp, Homo sapiens
ggccttttctgggtcttagatgagg

SEQ ID NO: 10870 - DNA, 25 bp, Homo sapiens
gccttttctgggtcttagatgagga

SEQ ID NO: 10871 - DNA, 25 bp, Homo sapiens
ccttttctgggtcttagatgaggaa

SEQ ID NO: 10872 - DNA, 25 bp, Homo sapiens
cttttctgggtcttagatgaggaag

SEQ ID NO: 10873 - DNA, 25 bp, Homo sapiens
ttttctgggtcttagatgaggaagt

SEQ ID NO: 10874 - DNA, 25 bp, Homo sapiens
tttctgggtcttagatgaggaagtc

SEQ ID NO: 10875 - DNA, 25 bp, Homo sapiens
ttctgggtcttagatgaggaagtcc

SEQ ID NO: 10876 - DNA, 25 bp, Homo sapiens
tctgggtcttagatgaggaagtcca

SEQ ID NO: 10877 - DNA, 25 bp, Homo sapiens
ctgggtcttagatgaggaagtccat

SEQ ID NO: 10878 - DNA, 25 bp, Homo sapiens
tgggtcttagatgaggaagtccatg

SEQ ID NO: 10879 - DNA, 25 bp, Homo sapiens
gggtcttagatgaggaagtccatgt

SEQ ID NO: 10880 - DNA, 25 bp, Homo sapiens
ggtcttagatgaggaagtccatgta

SEQ ID NO: 10881 - DNA, 25 bp, Homo sapiens
gtcttagatgaggaagtccatgtag

SEQ ID NO: 10882 - DNA, 25 bp, Homo sapiens
tcttagatgaggaagtccatgtaga

SEQ ID NO: 10883 - DNA, 25 bp, Homo sapiens
cttagatgaggaagtccatgtagag

SEQ ID NO: 10884 - DNA, 25 bp, Homo sapiens
ttagatgaggaagtccatgtagagg

SEQ ID NO: 10885 - DNA, 25 bp, Homo sapiens
tagatgaggaagtccatgtagaggg

SEQ ID NO: 10886 - DNA, 25 bp, Homo sapiens
agatgaggaagtccatgtagagggc

SEQ ID NO: 10887 - DNA, 25 bp, Homo sapiens
gatgaggaagtccatgtagagggct

SEQ ID NO: 10888 - DNA, 25 bp, Homo sapiens
atgaggaagtccatgtagagggctc

SEQ ID NO: 10889 - DNA, 25 bp, Homo sapiens
tgaggaagtccatgtagagggctcc

SEQ ID NO: 10890 - DNA, 25 bp, Homo sapiens
gaggaagtccatgtagagggctcca

SEQ ID NO: 10891 - DNA, 25 bp, Homo sapiens
aggaagtccatgtagagggctccag

SEQ ID NO: 10892 - DNA, 25 bp, Homo sapiens
ggaagtccatgtagagggctccagt

SEQ ID NO: 10893 - DNA, 25 bp, Homo sapiens
gaagtccatgtagagggctccagtg

SEQ ID NO: 10894 - DNA, 25 bp, Homo sapiens
aagtccatgtagagggctccagtga

SEQ ID NO: 10895 - DNA, 25 bp, Homo sapiens
agtccatgtagagggctccagtgac

SEQ ID NO: 10896 - DNA, 25 bp, Homo sapiens
gtccatgtagagggctccagtgaca

SEQ ID NO: 10897 - DNA, 25 bp, Homo sapiens
tccatgtagagggctccagtgacag

SEQ ID NO: 10898 - DNA, 25 bp, Homo sapiens
ccatgtagagggctccagtgacagt

SEQ ID NO: 10899 - DNA, 25 bp, Homo sapiens
catgtagagggctccagtgacagtg

SEQ ID NO: 10900 - DNA, 25 bp, Homo sapiens
atgtagagggctccagtgacagtgt

SEQ ID NO: 10901 - DNA, 25 bp, Homo sapiens
tgtagagggctccagtgacagtgtg

SEQ ID NO: 10902 - DNA, 25 bp, Homo sapiens
gtagagggctccagtgacagtgtgg

SEQ ID NO: 10903 - DNA, 25 bp, Homo sapiens
tagagggctccagtgacagtgtggt

SEQ ID NO: 10904 - DNA, 25 bp, Homo sapiens
agagggctccagtgacagtgtggtg

SEQ ID NO: 10905 - DNA, 25 bp, Homo sapiens
gagggctccagtgacagtgtggtgc

SEQ ID NO: 10906 - DNA, 25 bp, Homo sapiens
agggctccagtgacagtgtggtgct

SEQ ID NO: 10907 - DNA, 25 bp, Homo sapiens
gggctccagtgacagtgtggtgctc

SEQ ID NO: 10908 - DNA, 25 bp, Homo sapiens
ggctccagtgacagtgtggtgctcg

SEQ ID NO: 10909 - DNA, 25 bp, Homo sapiens
gctccagtgacagtgtggtgctcga

SEQ ID NO: 10910 - DNA, 25 bp, Homo sapiens
ctccagtgacagtgtggtgctcgag

SEQ ID NO: 10911 - DNA, 25 bp, Homo sapiens
tccagtgacagtgtggtgctcgagc

SEQ ID NO: 10912 - DNA, 25 bp, Homo sapiens
ccagtgacagtgtggtgctcgagcg

SEQ ID NO: 10913 - DNA, 25 bp, Homo sapiens
cagtgacagtgtggtgctcgagcgt

SEQ ID NO: 10914 - DNA, 25 bp, Homo sapiens
agtgacagtgtggtgctcgagcgtc

SEQ ID NO: 10915 - DNA, 25 bp, Homo sapiens
gtgacagtgtggtgctcgagcgtct

SEQ ID NO: 10916 - DNA, 25 bp, Homo sapiens
tgacagtgtggtgctcgagcgtctg

SEQ ID NO: 10917 - DNA, 25 bp, Homo sapiens
gacagtgtggtgctcgagcgtctgt

SEQ ID NO: 10918 - DNA, 25 bp, Homo sapiens
acagtgtggtgctcgagcgtctgtg

SEQ ID NO: 10919 - DNA, 25 bp, Homo sapiens
cagtgtggtgctcgagcgtctgtgt

SEQ ID NO: 10920 - DNA, 25 bp, Homo sapiens
agtgtggtgctcgagcgtctgtgtg

SEQ ID NO: 10921 - DNA, 25 bp, Homo sapiens
gtgtggtgctcgagcgtctgtgtgc

SEQ ID NO: 10922 - DNA, 25 bp, Homo sapiens
tgtggtgctcgagcgtctgtgtgct

SEQ ID NO: 10923 - DNA, 25 bp, Homo sapiens
gtggtgctcgagcgtctgtgtgcta

SEQ ID NO: 10924 - DNA, 25 bp, Homo sapiens
tggtgctcgagcgtctgtgtgctac

SEQ ID NO: 10925 - DNA, 25 bp, Homo sapiens
ggtgctcgagcgtctgtgtgctact

SEQ ID NO: 10926 - DNA, 25 bp, Homo sapiens
gtgctcgagcgtctgtgtgctactt

SEQ ID NO: 10927 - DNA, 25 bp, Homo sapiens
tgctcgagcgtctgtgtgctacttt

SEQ ID NO: 10928 - DNA, 25 bp, Homo sapiens
gctcgagcgtctgtgtgctactttc

SEQ ID NO: 10929 - DNA, 25 bp, Homo sapiens
ctcgagcgtctgtgtgctactttcg

SEQ ID NO: 10930 - DNA, 25 bp, Homo sapiens
tcgagcgtctgtgtgctactttcga

SEQ ID NO: 10931 - DNA, 25 bp, Homo sapiens
cgagcgtctgtgtgctactttcgag

SEQ ID NO: 10932 - DNA, 25 bp, Homo sapiens
gagcgtctgtgtgctactttcgaga

SEQ ID NO: 10933 - DNA, 25 bp, Homo sapiens
agcgtctgtgtgctactttcgagaa

SEQ ID NO: 10934 - DNA, 25 bp, Homo sapiens
gcgtctgtgtgctactttcgagaag

SEQ ID NO: 10935 - DNA, 25 bp, Homo sapiens
cgtctgtgtgctactttcgagaaga

SEQ ID NO: 10936 - DNA, 25 bp, Homo sapiens
gtctgtgtgctactttcgagaagaa

SEQ ID NO: 10937 - DNA, 25 bp, Homo sapiens
tctgtgtgctactttcgagaagaaa

SEQ ID NO: 10938 - DNA, 25 bp, Homo sapiens
ctgtgtgctactttcgagaagaaag

SEQ ID NO: 10939 - DNA, 25 bp, Homo sapiens
tgtgtgctactttcgagaagaaagg

SEQ ID NO: 10940 - DNA, 25 bp, Homo sapiens
gtgtgctactttcgagaagaaagga

SEQ ID NO: 10941 - DNA, 25 bp, Homo sapiens
tgtgctactttcgagaagaaaggag

SEQ ID NO: 10942 - DNA, 25 bp, Homo sapiens
gtgctactttcgagaagaaaggagc

SEQ ID NO: 10943 - DNA, 25 bp, Homo sapiens
tgctactttcgagaagaaaggagct

SEQ ID NO: 10944 - DNA, 25 bp, Homo sapiens
gctactttcgagaagaaaggagctg

SEQ ID NO: 10945 - DNA, 25 bp, Homo sapiens
ctactttcgagaagaaaggagctgg

SEQ ID NO: 10946 - DNA, 25 bp, Homo sapiens
tactttcgagaagaaaggagctggg

SEQ ID NO: 10947 - DNA, 25 bp, Homo sapiens
actttcgagaagaaaggagctggga

SEQ ID NO: 10948 - DNA, 25 bp, Homo sapiens
ctttcgagaagaaaggagctgggac

SEQ ID NO: 10949 - DNA, 25 bp, Homo sapiens
tttcgagaagaaaggagctgggact

SEQ ID NO: 10950 - DNA, 25 bp, Homo sapiens
ttcgagaagaaaggagctgggactg

SEQ ID NO: 10951 - DNA, 25 bp, Homo sapiens
tcgagaagaaaggagctgggactga

SEQ ID NO: 10952 - DNA, 25 bp, Homo sapiens
cgagaagaaaggagctgggactgaa

SEQ ID NO: 10953 - DNA, 25 bp, Homo sapiens
gagaagaaaggagctgggactgaag

SEQ ID NO: 10954 - DNA, 25 bp, Homo sapiens
agaagaaaggagctgggactgaagg

SEQ ID NO: 10955 - DNA, 25 bp, Homo sapiens
gaagaaaggagctgggactgaaggg

SEQ ID NO: 10956 - DNA, 25 bp, Homo sapiens
aagaaaggagctgggactgaagggt

SEQ ID NO: 10957 - DNA, 25 bp, Homo sapiens
agaaaggagctgggactgaagggtc

SEQ ID NO: 10958 - DNA, 25 bp, Homo sapiens
gaaaggagctgggactgaagggtcc

SEQ ID NO: 10959 - DNA, 25 bp, Homo sapiens
aaaggagctgggactgaagggtcct

SEQ ID NO: 10960 - DNA, 25 bp, Homo sapiens
aaggagctgggactgaagggtcctc

SEQ ID NO: 10961 - DNA, 25 bp, Homo sapiens
aggagctgggactgaagggtcctct

SEQ ID NO: 10962 - DNA, 25 bp, Homo sapiens
ggagctgggactgaagggtcctctg

SEQ ID NO: 10963 - DNA, 25 bp, Homo sapiens
gagctgggactgaagggtcctctgc

SEQ ID NO: 10964 - DNA, 25 bp, Homo sapiens
agctgggactgaagggtcctctgcc

SEQ ID NO: 10965 - DNA, 25 bp, Homo sapiens
gctgggactgaagggtcctctgccc

SEQ ID NO: 10966 - DNA, 25 bp, Homo sapiens
ctgggactgaagggtcctctgccct

SEQ ID NO: 10967 - DNA, 25 bp, Homo sapiens
tgggactgaagggtcctctgccctg

SEQ ID NO: 10968 - DNA, 25 bp, Homo sapiens
gggactgaagggtcctctgccctgc

SEQ ID NO: 10969 - DNA, 25 bp, Homo sapiens
ggactgaagggtcctctgccctgcg

SEQ ID NO: 10970 - DNA, 25 bp, Homo sapiens
gactgaagggtcctctgccctgcgg

SEQ ID NO: 10971 - DNA, 25 bp, Homo sapiens
actgaagggtcctctgccctgcgga

SEQ ID NO: 10972 - DNA, 25 bp, Homo sapiens
ctgaagggtcctctgccctgcggac

SEQ ID NO: 10973 - DNA, 25 bp, Homo sapiens
tgaagggtcctctgccctgcggacc

SEQ ID NO: 10974 - DNA, 25 bp, Homo sapiens
gaagggtcctctgccctgcggacct

SEQ ID NO: 10975 - DNA, 25 bp, Homo sapiens
aagggtcctctgccctgcggacctg

SEQ ID NO: 10976 - DNA, 25 bp, Homo sapiens
agggtcctctgccctgcggacctgt

SEQ ID NO: 10977 - DNA, 25 bp, Homo sapiens
gggtcctctgccctgcggacctgtg

SEQ ID NO: 10978 - DNA, 25 bp, Homo sapiens
ggtcctctgccctgcggacctgtga

SEQ ID NO: 10979 - DNA, 25 bp, Homo sapiens
gtcctctgccctgcggacctgtgag

SEQ ID NO: 10980 - DNA, 25 bp, Homo sapiens
tcctctgccctgcggacctgtgagc

SEQ ID NO: 10981 - DNA, 25 bp, Homo sapiens
cctctgccctgcggacctgtgagca

SEQ ID NO: 10982 - DNA, 25 bp, Homo sapiens
ctctgccctgcggacctgtgagcag

SEQ ID NO: 10983 - DNA, 25 bp, Homo sapiens
tctgccctgcggacctgtgagcagc

SEQ ID NO: 10984 - DNA, 25 bp, Homo sapiens
ctgccctgcggacctgtgagcagcc

SEQ ID NO: 10985 - DNA, 25 bp, Homo sapiens
tgccctgcggacctgtgagcagccc

SEQ ID NO: 10986 - DNA, 25 bp, Homo sapiens
gccctgcggacctgtgagcagcccc

SEQ ID NO: 10987 - DNA, 25 bp, Homo sapiens
ccctgcggacctgtgagcagcccct

SEQ ID NO: 10988 - DNA, 25 bp, Homo sapiens
cctgcggacctgtgagcagcccctc

SEQ ID NO: 10989 - DNA, 25 bp, Homo sapiens
ctgcggacctgtgagcagcccctcc

SEQ ID NO: 10990 - DNA, 25 bp, Homo sapiens
tgcggacctgtgagcagcccctcca

SEQ ID NO: 10991 - DNA, 25 bp, Homo sapiens
gcggacctgtgagcagcccctccag

SEQ ID NO: 10992 - DNA, 25 bp, Homo sapiens
cggacctgtgagcagcccctccagt

SEQ ID NO: 10993 - DNA, 25 bp, Homo sapiens
ggacctgtgagcagcccctccagtg

SEQ ID NO: 10994 - DNA, 25 bp, Homo sapiens
gacctgtgagcagcccctccagtgt

SEQ ID NO: 10995 - DNA, 25 bp, Homo sapiens
acctgtgagcagcccctccagtgtg

SEQ ID NO: 10996 - DNA, 25 bp, Homo sapiens
cctgtgagcagcccctccagtgtga

SEQ ID NO: 10997 - DNA, 25 bp, Homo sapiens
ctgtgagcagcccctccagtgtgag

SEQ ID NO: 10998 - DNA, 25 bp, Homo sapiens
tgtgagcagcccctccagtgtgaga

SEQ ID NO: 10999 - DNA, 25 bp, Homo sapiens
gtgagcagcccctccagtgtgagat

SEQ ID NO: 11000 - DNA, 25 bp, Homo sapiens
tgagcagcccctccagtgtgagatt

SEQ ID NO: 11001 - DNA, 25 bp, Homo sapiens
gagcagcccctccagtgtgagattt

SEQ ID NO: 11002 - DNA, 25 bp, Homo sapiens
agcagcccctccagtgtgagatttt

SEQ ID NO: 11003 - DNA, 25 bp, Homo sapiens
gcagcccctccagtgtgagattttc

SEQ ID NO: 11004 - DNA, 25 bp, Homo sapiens
cagcccctccagtgtgagattttcc

SEQ ID NO: 11005 - DNA, 25 bp, Homo sapiens
agcccctccagtgtgagattttcca

SEQ ID NO: 11006 - DNA, 25 bp, Homo sapiens
gcccctccagtgtgagattttccac

SEQ ID NO: 11007 - DNA, 25 bp, Homo sapiens
cccctccagtgtgagattttccacc

SEQ ID NO: 11008 - DNA, 25 bp, Homo sapiens
ccctccagtgtgagattttccacca

SEQ ID NO: 11009 - DNA, 25 bp, Homo sapiens
cctccagtgtgagattttccaccag

SEQ ID NO: 11010 - DNA, 25 bp, Homo sapiens
ctccagtgtgagattttccaccagt

SEQ ID NO: 11011 - DNA, 25 bp, Homo sapiens
tccagtgtgagattttccaccagtt

SEQ ID NO: 11012 - DNA, 25 bp, Homo sapiens
ccagtgtgagattttccaccagttg

SEQ ID NO: 11013 - DNA, 25 bp, Homo sapiens
cagtgtgagattttccaccagttgg

SEQ ID NO: 11014 - DNA, 25 bp, Homo sapiens
agtgtgagattttccaccagttggg

SEQ ID NO: 11015 - DNA, 25 bp, Homo sapiens
gtgtgagattttccaccagttggga

SEQ ID NO: 11016 - DNA, 25 bp, Homo sapiens
tgtgagattttccaccagttgggat

SEQ ID NO: 11017 - DNA, 25 bp, Homo sapiens
gtgagattttccaccagttgggatg

SEQ ID NO: 11018 - DNA, 25 bp, Homo sapiens
tgagattttccaccagttgggatgg

SEQ ID NO: 11019 - DNA, 25 bp, Homo sapiens
gagattttccaccagttgggatggg

SEQ ID NO: 11020 - DNA, 25 bp, Homo sapiens
agattttccaccagttgggatggga

SEQ ID NO: 11021 - DNA, 25 bp, Homo sapiens
gattttccaccagttgggatgggac

SEQ ID NO: 11022 - DNA, 25 bp, Homo sapiens
attttccaccagttgggatgggacc

SEQ ID NO: 11023 - DNA, 25 bp, Homo sapiens
ttttccaccagttgggatgggaccc

SEQ ID NO: 11024 - DNA, 25 bp, Homo sapiens
tttccaccagttgggatgggaccct

SEQ ID NO: 11025 - DNA, 25 bp, Homo sapiens
ttccaccagttgggatgggaccctg

SEQ ID NO: 11026 - DNA, 25 bp, Homo sapiens
tccaccagttgggatgggaccctgt

SEQ ID NO: 11027 - DNA, 25 bp, Homo sapiens
ccaccagttgggatgggaccctgtg

SEQ ID NO: 11028 - DNA, 25 bp, Homo sapiens
caccagttgggatgggaccctgtgc

SEQ ID NO: 11029 - DNA, 25 bp, Homo sapiens
accagttgggatgggaccctgtgcg

SEQ ID NO: 11030 - DNA, 25 bp, Homo sapiens
ccagttgggatgggaccctgtgcgg

SEQ ID NO: 11031 - DNA, 25 bp, Homo sapiens
cagttgggatgggaccctgtgcggt

SEQ ID NO: 11032 - DNA, 25 bp, Homo sapiens
agttgggatgggaccctgtgcggta

SEQ ID NO: 11033 - DNA, 25 bp, Homo sapiens
gttgggatgggaccctgtgcggtac

SEQ ID NO: 11034 - DNA, 25 bp, Homo sapiens
ttgggatgggaccctgtgcggtacg

SEQ ID NO: 11035 - DNA, 25 bp, Homo sapiens
tgggatgggaccctgtgcggtacga

SEQ ID NO: 11036 - DNA, 25 bp, Homo sapiens
gggatgggaccctgtgcggtacgac

SEQ ID NO: 11037 - DNA, 25 bp, Homo sapiens
ggatgggaccctgtgcggtacgacc

SEQ ID NO: 11038 - DNA, 25 bp, Homo sapiens
gatgggaccctgtgcggtacgacct

SEQ ID NO: 11039 - DNA, 25 bp, Homo sapiens
atgggaccctgtgcggtacgacctc

SEQ ID NO: 11040 - DNA, 25 bp, Homo sapiens
tgggaccctgtgcggtacgacctca

SEQ ID NO: 11041 - DNA, 25 bp, Homo sapiens
gggaccctgtgcggtacgacctcac

SEQ ID NO: 11042 - DNA, 25 bp, Homo sapiens
ggaccctgtgcggtacgacctcacg

SEQ ID NO: 11043 - DNA, 25 bp, Homo sapiens
gaccctgtgcggtacgacctcacgg

SEQ ID NO: 11044 - DNA, 25 bp, Homo sapiens
accctgtgcggtacgacctcacggg

SEQ ID NO: 11045 - DNA, 25 bp, Homo sapiens
ccctgtgcggtacgacctcacgggc

SEQ ID NO: 11046 - DNA, 25 bp, Homo sapiens
cctgtgcggtacgacctcacgggct

SEQ ID NO: 11047 - DNA, 25 bp, Homo sapiens
ctgtgcggtacgacctcacgggctg

SEQ ID NO: 11048 - DNA, 25 bp, Homo sapiens
tgtgcggtacgacctcacgggctgg

SEQ ID NO: 11049 - DNA, 25 bp, Homo sapiens
gtgcggtacgacctcacgggctggc

SEQ ID NO: 11050 - DNA, 25 bp, Homo sapiens
tgcggtacgacctcacgggctggct

SEQ ID NO: 11051 - DNA, 25 bp, Homo sapiens
gcggtacgacctcacgggctggctc

SEQ ID NO: 11052 - DNA, 25 bp, Homo sapiens
cggtacgacctcacgggctggctcc

SEQ ID NO: 11053 - DNA, 25 bp, Homo sapiens
ggtacgacctcacgggctggctcca

SEQ ID NO: 11054 - DNA, 25 bp, Homo sapiens
gtacgacctcacgggctggctccac

SEQ ID NO: 11055 - DNA, 25 bp, Homo sapiens
tacgacctcacgggctggctccaca

SEQ ID NO: 11056 - DNA, 25 bp, Homo sapiens
acgacctcacgggctggctccacag

SEQ ID NO: 11057 - DNA, 25 bp, Homo sapiens
cgacctcacgggctggctccacaga

SEQ ID NO: 11058 - DNA, 25 bp, Homo sapiens
gacctcacgggctggctccacagag

SEQ ID NO: 11059 - DNA, 25 bp, Homo sapiens
acctcacgggctggctccacagagc

SEQ ID NO: 11060 - DNA, 25 bp, Homo sapiens
cctcacgggctggctccacagagcc

SEQ ID NO: 11061 - DNA, 25 bp, Homo sapiens
ctcacgggctggctccacagagcca

SEQ ID NO: 11062 - DNA, 25 bp, Homo sapiens
tcacgggctggctccacagagccaa

SEQ ID NO: 11063 - DNA, 25 bp, Homo sapiens
cacgggctggctccacagagccaag

SEQ ID NO: 11064 - DNA, 25 bp, Homo sapiens
acgggctggctccacagagccaagc

SEQ ID NO: 11065 - DNA, 25 bp, Homo sapiens
cgggctggctccacagagccaagcc

SEQ ID NO: 11066 - DNA, 25 bp, Homo sapiens
gggctggctccacagagccaagccc

SEQ ID NO: 11067 - DNA, 25 bp, Homo sapiens
ggctggctccacagagccaagccca

SEQ ID NO: 11068 - DNA, 25 bp, Homo sapiens
gctggctccacagagccaagcccaa

SEQ ID NO: 11069 - DNA, 25 bp, Homo sapiens
ctggctccacagagccaagcccaac

SEQ ID NO: 11070 - DNA, 25 bp, Homo sapiens
tggctccacagagccaagcccaacc

SEQ ID NO: 11071 - DNA, 25 bp, Homo sapiens
ggctccacagagccaagcccaacct

SEQ ID NO: 11072 - DNA, 25 bp, Homo sapiens
gctccacagagccaagcccaacctc

SEQ ID NO: 11073 - DNA, 25 bp, Homo sapiens
ctccacagagccaagcccaacctct

SEQ ID NO: 11074 - DNA, 25 bp, Homo sapiens
tccacagagccaagcccaacctctc

SEQ ID NO: 11075 - DNA, 25 bp, Homo sapiens
ccacagagccaagcccaacctctcg

SEQ ID NO: 11076 - DNA, 25 bp, Homo sapiens
cacagagccaagcccaacctctcgg

SEQ ID NO: 11077 - DNA, 25 bp, Homo sapiens
acagagccaagcccaacctctcggc

SEQ ID NO: 11078 - DNA, 25 bp, Homo sapiens
cagagccaagcccaacctctcggcc

SEQ ID NO: 11079 - DNA, 25 bp, Homo sapiens
agagccaagcccaacctctcggccc

SEQ ID NO: 11080 - DNA, 25 bp, Homo sapiens
gagccaagcccaacctctcggccct

SEQ ID NO: 11081 - DNA, 25 bp, Homo sapiens
agccaagcccaacctctcggccctg

SEQ ID NO: 11082 - DNA, 25 bp, Homo sapiens
gccaagcccaacctctcggccctgg

SEQ ID NO: 11083 - DNA, 25 bp, Homo sapiens
ccaagcccaacctctcggccctgga

SEQ ID NO: 11084 - DNA, 25 bp, Homo sapiens
caagcccaacctctcggccctggat

SEQ ID NO: 11085 - DNA, 25 bp, Homo sapiens
aagcccaacctctcggccctggatg

SEQ ID NO: 11086 - DNA, 25 bp, Homo sapiens
agcccaacctctcggccctggatgc

SEQ ID NO: 11087 - DNA, 25 bp, Homo sapiens
gcccaacctctcggccctggatgca

SEQ ID NO: 11088 - DNA, 25 bp, Homo sapiens
cccaacctctcggccctggatgcac

SEQ ID NO: 11089 - DNA, 25 bp, Homo sapiens
ccaacctctcggccctggatgcacc

SEQ ID NO: 11090 - DNA, 25 bp, Homo sapiens
caacctctcggccctggatgcaccc

SEQ ID NO: 11091 - DNA, 25 bp, Homo sapiens
aacctctcggccctggatgcacccc

SEQ ID NO: 11092 - DNA, 25 bp, Homo sapiens
acctctcggccctggatgcacccca

SEQ ID NO: 11093 - DNA, 25 bp, Homo sapiens
cctctcggccctggatgcaccccag

SEQ ID NO: 11094 - DNA, 25 bp, Homo sapiens
ctctcggccctggatgcaccccagg

SEQ ID NO: 11095 - DNA, 25 bp, Homo sapiens
tctcggccctggatgcaccccaggt

SEQ ID NO: 11096 - DNA, 25 bp, Homo sapiens
ctcggccctggatgcaccccaggtc

SEQ ID NO: 11097 - DNA, 25 bp, Homo sapiens
tcggccctggatgcaccccaggtcc

SEQ ID NO: 11098 - DNA, 25 bp, Homo sapiens
cggccctggatgcaccccaggtcct

SEQ ID NO: 11099 - DNA, 25 bp, Homo sapiens
ggccctggatgcaccccaggtcctg

SEQ ID NO: 11100 - DNA, 25 bp, Homo sapiens
gccctggatgcaccccaggtcctgc

SEQ ID NO: 11101 - DNA, 25 bp, Homo sapiens
ccctggatgcaccccaggtcctgca

SEQ ID NO: 11102 - DNA, 25 bp, Homo sapiens
cctggatgcaccccaggtcctgcaa

SEQ ID NO: 11103 - DNA, 25 bp, Homo sapiens
ctggatgcaccccaggtcctgcaac

SEQ ID NO: 11104 - DNA, 25 bp, Homo sapiens
tggatgcaccccaggtcctgcaaca

SEQ ID NO: 11105 - DNA, 25 bp, Homo sapiens
ggatgcaccccaggtcctgcaacag

SEQ ID NO: 11106 - DNA, 25 bp, Homo sapiens
gatgcaccccaggtcctgcaacagt

SEQ ID NO: 11107 - DNA, 25 bp, Homo sapiens
atgcaccccaggtcctgcaacagtc

SEQ ID NO: 11108 - DNA, 25 bp, Homo sapiens
tgcaccccaggtcctgcaacagtca

SEQ ID NO: 11109 - DNA, 25 bp, Homo sapiens
gcaccccaggtcctgcaacagtcaa

SEQ ID NO: 11110 - DNA, 25 bp, Homo sapiens
caccccaggtcctgcaacagtcaaa

SEQ ID NO: 11111 - DNA, 25 bp, Homo sapiens
accccaggtcctgcaacagtcaaaa

SEQ ID NO: 11112 - DNA, 25 bp, Homo sapiens
ccccaggtcctgcaacagtcaaaaa

SEQ ID NO: 11113 - DNA, 25 bp, Homo sapiens
cccaggtcctgcaacagtcaaaaag

SEQ ID NO: 11114 - DNA, 25 bp, Homo sapiens
ccaggtcctgcaacagtcaaaaaga

SEQ ID NO: 11115 - DNA, 25 bp, Homo sapiens
caggtcctgcaacagtcaaaaagag

SEQ ID NO: 11116 - DNA, 25 bp, Homo sapiens
aggtcctgcaacagtcaaaaagaga

SEQ ID NO: 11117 - DNA, 25 bp, Homo sapiens
ggtcctgcaacagtcaaaaagagag

SEQ ID NO: 11118 - DNA, 25 bp, Homo sapiens
gtcctgcaacagtcaaaaagagagg

SEQ ID NO: 11119 - DNA, 25 bp, Homo sapiens
tcctgcaacagtcaaaaagagagga

SEQ ID NO: 11120 - DNA, 25 bp, Homo sapiens
cctgcaacagtcaaaaagagaggag

SEQ ID NO: 11121 - DNA, 25 bp, Homo sapiens
ctgcaacagtcaaaaagagaggagc

SEQ ID NO: 11122 - DNA, 25 bp, Homo sapiens
tgcaacagtcaaaaagagaggagct

SEQ ID NO: 11123 - DNA, 25 bp, Homo sapiens
gcaacagtcaaaaagagaggagctg

SEQ ID NO: 11124 - DNA, 25 bp, Homo sapiens
caacagtcaaaaagagaggagctgc

SEQ ID NO: 11125 - DNA, 25 bp, Homo sapiens
aacagtcaaaaagagaggagctgcg

SEQ ID NO: 11126 - DNA, 25 bp, Homo sapiens
acagtcaaaaagagaggagctgcgg

SEQ ID NO: 11127 - DNA, 25 bp, Homo sapiens
cagtcaaaaagagaggagctgcgga

SEQ ID NO: 11128 - DNA, 25 bp, Homo sapiens
agtcaaaaagagaggagctgcggag

SEQ ID NO: 11129 - DNA, 25 bp, Homo sapiens
gtcaaaaagagaggagctgcggagt

SEQ ID NO: 11130 - DNA, 25 bp, Homo sapiens
tcaaaaagagaggagctgcggagtc

SEQ ID NO: 11131 - DNA, 25 bp, Homo sapiens
caaaaagagaggagctgcggagtct

SEQ ID NO: 11132 - DNA, 25 bp, Homo sapiens
aaaaagagaggagctgcggagtcta

SEQ ID NO: 11133 - DNA, 25 bp, Homo sapiens
aaaagagaggagctgcggagtctat

SEQ ID NO: 11134 - DNA, 25 bp, Homo sapiens
aaagagaggagctgcggagtctatt

SEQ ID NO: 11135 - DNA, 25 bp, Homo sapiens
aagagaggagctgcggagtctattc

SEQ ID NO: 11136 - DNA, 25 bp, Homo sapiens
agagaggagctgcggagtctattcc

SEQ ID NO: 11137 - DNA, 25 bp, Homo sapiens
gagaggagctgcggagtctattcca

SEQ ID NO: 11138 - DNA, 25 bp, Homo sapiens
agaggagctgcggagtctattccag

SEQ ID NO: 11139 - DNA, 25 bp, Homo sapiens
gaggagctgcggagtctattccagg

SEQ ID NO: 11140 - DNA, 25 bp, Homo sapiens
aggagctgcggagtctattccaggc

SEQ ID NO: 11141 - DNA, 25 bp, Homo sapiens
ggagctgcggagtctattccaggcc

SEQ ID NO: 11142 - DNA, 25 bp, Homo sapiens
gagctgcggagtctattccaggccc

SEQ ID NO: 11143 - DNA, 25 bp, Homo sapiens
agctgcggagtctattccaggcccg

SEQ ID NO: 11144 - DNA, 25 bp, Homo sapiens
gctgcggagtctattccaggcccgg

SEQ ID NO: 11145 - DNA, 25 bp, Homo sapiens
ctgcggagtctattccaggcccggg

SEQ ID NO: 11146 - DNA, 25 bp, Homo sapiens
tgcggagtctattccaggcccgggc

SEQ ID NO: 11147 - DNA, 25 bp, Homo sapiens
gcggagtctattccaggcccgggcc

SEQ ID NO: 11148 - DNA, 25 bp, Homo sapiens
cggagtctattccaggcccgggcca

SEQ ID NO: 11149 - DNA, 25 bp, Homo sapiens
ggagtctattccaggcccgggccaa

SEQ ID NO: 11150 - DNA, 25 bp, Homo sapiens
gagtctattccaggcccgggccaag

SEQ ID NO: 11151 - DNA, 25 bp, Homo sapiens
agtctattccaggcccgggccaagc

SEQ ID NO: 11152 - DNA, 25 bp, Homo sapiens
gtctattccaggcccgggccaagct

SEQ ID NO: 11153 - DNA, 25 bp, Homo sapiens
tctattccaggcccgggccaagctg

SEQ ID NO: 11154 - DNA, 25 bp, Homo sapiens
ctattccaggcccgggccaagctgc

SEQ ID NO: 11155 - DNA, 25 bp, Homo sapiens
tattccaggcccgggccaagctgcc

SEQ ID NO: 11156 - DNA, 25 bp, Homo sapiens
attccaggcccgggccaagctgcct

SEQ ID NO: 11157 - DNA, 25 bp, Homo sapiens
ttccaggcccgggccaagctgcctc

SEQ ID NO: 11158 - DNA, 25 bp, Homo sapiens
tccaggcccgggccaagctgcctcc

SEQ ID NO: 11159 - DNA, 25 bp, Homo sapiens
ccaggcccgggccaagctgcctcct

SEQ ID NO: 11160 - DNA, 25 bp, Homo sapiens
caggcccgggccaagctgcctcctg

SEQ ID NO: 11161 - DNA, 25 bp, Homo sapiens
aggcccgggccaagctgcctcctgt

SEQ ID NO: 11162 - DNA, 25 bp, Homo sapiens
ggcccgggccaagctgcctcctgtg

SEQ ID NO: 11163 - DNA, 25 bp, Homo sapiens
gcccgggccaagctgcctcctgtgt

SEQ ID NO: 11164 - DNA, 25 bp, Homo sapiens
cccgggccaagctgcctcctgtgtg

SEQ ID NO: 11165 - DNA, 25 bp, Homo sapiens
ccgggccaagctgcctcctgtgtgc

SEQ ID NO: 11166 - DNA, 25 bp, Homo sapiens
cgggccaagctgcctcctgtgtgcc

SEQ ID NO: 11167 - DNA, 25 bp, Homo sapiens
gggccaagctgcctcctgtgtgccg

SEQ ID NO: 11168 - DNA, 25 bp, Homo sapiens
ggccaagctgcctcctgtgtgccgg

SEQ ID NO: 11169 - DNA, 25 bp, Homo sapiens
gccaagctgcctcctgtgtgccggg

SEQ ID NO: 11170 - DNA, 25 bp, Homo sapiens
ccaagctgcctcctgtgtgccgggc

SEQ ID NO: 11171 - DNA, 25 bp, Homo sapiens
caagctgcctcctgtgtgccgggct

SEQ ID NO: 11172 - DNA, 25 bp, Homo sapiens
aagctgcctcctgtgtgccgggctg

SEQ ID NO: 11173 - DNA, 25 bp, Homo sapiens
agctgcctcctgtgtgccgggctgt

SEQ ID NO: 11174 - DNA, 25 bp, Homo sapiens
gctgcctcctgtgtgccgggctgtg

SEQ ID NO: 11175 - DNA, 25 bp, Homo sapiens
ctgcctcctgtgtgccgggctgtgg

SEQ ID NO: 11176 - DNA, 25 bp, Homo sapiens
tgcctcctgtgtgccgggctgtggc

SEQ ID NO: 11177 - DNA, 25 bp, Homo sapiens
gcctcctgtgtgccgggctgtggca

SEQ ID NO: 11178 - DNA, 25 bp, Homo sapiens
cctcctgtgtgccgggctgtggcag

SEQ ID NO: 11179 - DNA, 25 bp, Homo sapiens
ctcctgtgtgccgggctgtggcagg

SEQ ID NO: 11180 - DNA, 25 bp, Homo sapiens
tcctgtgtgccgggctgtggcaggc

SEQ ID NO: 11181 - DNA, 25 bp, Homo sapiens
cctgtgtgccgggctgtggcaggcc

SEQ ID NO: 11182 - DNA, 25 bp, Homo sapiens
ctgtgtgccgggctgtggcaggcct

SEQ ID NO: 11183 - DNA, 25 bp, Homo sapiens
tgtgtgccgggctgtggcaggcctg

SEQ ID NO: 11184 - DNA, 25 bp, Homo sapiens
gtgtgccgggctgtggcaggcctgg

SEQ ID NO: 11185 - DNA, 25 bp, Homo sapiens
tgtgccgggctgtggcaggcctgga

SEQ ID NO: 11186 - DNA, 25 bp, Homo sapiens
gtgccgggctgtggcaggcctggag

SEQ ID NO: 11187 - DNA, 25 bp, Homo sapiens
tgccgggctgtggcaggcctggagg

SEQ ID NO: 11188 - DNA, 25 bp, Homo sapiens
gccgggctgtggcaggcctggaggg

SEQ ID NO: 11189 - DNA, 25 bp, Homo sapiens
ccgggctgtggcaggcctggagggc

SEQ ID NO: 11190 - DNA, 25 bp, Homo sapiens
cgggctgtggcaggcctggagggca

SEQ ID NO: 11191 - DNA, 25 bp, Homo sapiens
gggctgtggcaggcctggagggcac

SEQ ID NO: 11192 - DNA, 25 bp, Homo sapiens
ggctgtggcaggcctggagggcacc

SEQ ID NO: 11193 - DNA, 25 bp, Homo sapiens
gctgtggcaggcctggagggcacct

SEQ ID NO: 11194 - DNA, 25 bp, Homo sapiens
ctgtggcaggcctggagggcacctc

SEQ ID NO: 11195 - DNA, 25 bp, Homo sapiens
tgtggcaggcctggagggcacctcc

SEQ ID NO: 11196 - DNA, 25 bp, Homo sapiens
gtggcaggcctggagggcacctccc

SEQ ID NO: 11197 - DNA, 25 bp, Homo sapiens
tggcaggcctggagggcacctccca

SEQ ID NO: 11198 - DNA, 25 bp, Homo sapiens
ggcaggcctggagggcacctcccag

SEQ ID NO: 11199 - DNA, 25 bp, Homo sapiens
gcaggcctggagggcacctcccagc

SEQ ID NO: 11200 - DNA, 25 bp, Homo sapiens
caggcctggagggcacctcccagca

SEQ ID NO: 11201 - DNA, 25 bp, Homo sapiens
aggcctggagggcacctcccagcag

SEQ ID NO: 11202 - DNA, 25 bp, Homo sapiens
ggcctggagggcacctcccagcagg

SEQ ID NO: 11203 - DNA, 25 bp, Homo sapiens
gcctggagggcacctcccagcaggc

SEQ ID NO: 11204 - DNA, 25 bp, Homo sapiens
cctggagggcacctcccagcaggcc

SEQ ID NO: 11205 - DNA, 25 bp, Homo sapiens
ctggagggcacctcccagcaggccc

SEQ ID NO: 11206 - DNA, 25 bp, Homo sapiens
tggagggcacctcccagcaggccct

SEQ ID NO: 11207 - DNA, 25 bp, Homo sapiens
ggagggcacctcccagcaggccctg

SEQ ID NO: 11208 - DNA, 25 bp, Homo sapiens
gagggcacctcccagcaggccctgc

SEQ ID NO: 11209 - DNA, 25 bp, Homo sapiens
agggcacctcccagcaggccctgca

SEQ ID NO: 11210 - DNA, 25 bp, Homo sapiens
gggcacctcccagcaggccctgcag

SEQ ID NO: 11211 - DNA, 25 bp, Homo sapiens
ggcacctcccagcaggccctgcaga

SEQ ID NO: 11212 - DNA, 25 bp, Homo sapiens
gcacctcccagcaggccctgcagag

SEQ ID NO: 11213 - DNA, 25 bp, Homo sapiens
cacctcccagcaggccctgcagagg

SEQ ID NO: 11214 - DNA, 25 bp, Homo sapiens
acctcccagcaggccctgcagagga

SEQ ID NO: 11215 - DNA, 25 bp, Homo sapiens
cctcccagcaggccctgcagaggag

SEQ ID NO: 11216 - DNA, 25 bp, Homo sapiens
ctcccagcaggccctgcagaggagc

SEQ ID NO: 11217 - DNA, 25 bp, Homo sapiens
tcccagcaggccctgcagaggagcc

SEQ ID NO: 11218 - DNA, 25 bp, Homo sapiens
cccagcaggccctgcagaggagccg

SEQ ID NO: 11219 - DNA, 25 bp, Homo sapiens
ccagcaggccctgcagaggagccgc

SEQ ID NO: 11220 - DNA, 25 bp, Homo sapiens
cagcaggccctgcagaggagccgca

SEQ ID NO: 11221 - DNA, 25 bp, Homo sapiens
agcaggccctgcagaggagccgcat

SEQ ID NO: 11222 - DNA, 25 bp, Homo sapiens
gcaggccctgcagaggagccgcatg

SEQ ID NO: 11223 - DNA, 25 bp, Homo sapiens
caggccctgcagaggagccgcatgg

SEQ ID NO: 11224 - DNA, 25 bp, Homo sapiens
aggccctgcagaggagccgcatggt

SEQ ID NO: 11225 - DNA, 25 bp, Homo sapiens
ggccctgcagaggagccgcatggtg

SEQ ID NO: 11226 - DNA, 25 bp, Homo sapiens
gccctgcagaggagccgcatggtga

SEQ ID NO: 11227 - DNA, 25 bp, Homo sapiens
ccctgcagaggagccgcatggtgag

SEQ ID NO: 11228 - DNA, 25 bp, Homo sapiens
cctgcagaggagccgcatggtgagg

SEQ ID NO: 11229 - DNA, 25 bp, Homo sapiens
ctgcagaggagccgcatggtgagga

SEQ ID NO: 11230 - DNA, 25 bp, Homo sapiens
tgcagaggagccgcatggtgaggag

SEQ ID NO: 11231 - DNA, 25 bp, Homo sapiens
gcagaggagccgcatggtgaggagg

SEQ ID NO: 11232 - DNA, 25 bp, Homo sapiens
cagaggagccgcatggtgaggagga

SEQ ID NO: 11233 - DNA, 25 bp, Homo sapiens
agaggagccgcatggtgaggaggac

SEQ ID NO: 11234 - DNA, 25 bp, Homo sapiens
gaggagccgcatggtgaggaggacc

SEQ ID NO: 11235 - DNA, 25 bp, Homo sapiens
aggagccgcatggtgaggaggacct

SEQ ID NO: 11236 - DNA, 25 bp, Homo sapiens
ggagccgcatggtgaggaggacctt

SEQ ID NO: 11237 - DNA, 25 bp, Homo sapiens
gagccgcatggtgaggaggaccttt

SEQ ID NO: 11238 - DNA, 25 bp, Homo sapiens
agccgcatggtgaggaggacctttg

SEQ ID NO: 11239 - DNA, 25 bp, Homo sapiens
gccgcatggtgaggaggacctttgc

SEQ ID NO: 11240 - DNA, 25 bp, Homo sapiens
ccgcatggtgaggaggacctttgcc

SEQ ID NO: 11241 - DNA, 25 bp, Homo sapiens
cgcatggtgaggaggacctttgcca

SEQ ID NO: 11242 - DNA, 25 bp, Homo sapiens
gcatggtgaggaggacctttgccag

SEQ ID NO: 11243 - DNA, 25 bp, Homo sapiens
catggtgaggaggacctttgccagc

SEQ ID NO: 11244 - DNA, 25 bp, Homo sapiens
atggtgaggaggacctttgccagca

SEQ ID NO: 11245 - DNA, 25 bp, Homo sapiens
tggtgaggaggacctttgccagcag

SEQ ID NO: 11246 - DNA, 25 bp, Homo sapiens
ggtgaggaggacctttgccagcagc

SEQ ID NO: 11247 - DNA, 25 bp, Homo sapiens
gtgaggaggacctttgccagcagcc

SEQ ID NO: 11248 - DNA, 25 bp, Homo sapiens
tgaggaggacctttgccagcagcct

SEQ ID NO: 11249 - DNA, 25 bp, Homo sapiens
gaggaggacctttgccagcagcctt

SEQ ID NO: 11250 - DNA, 25 bp, Homo sapiens
aggaggacctttgccagcagccttg

SEQ ID NO: 11251 - DNA, 25 bp, Homo sapiens
ggaggacctttgccagcagccttgc

SEQ ID NO: 11252 - DNA, 25 bp, Homo sapiens
gaggacctttgccagcagccttgcc

SEQ ID NO: 11253 - DNA, 25 bp, Homo sapiens
aggacctttgccagcagccttgccg

SEQ ID NO: 11254 - DNA, 25 bp, Homo sapiens
ggacctttgccagcagccttgccgc

SEQ ID NO: 11255 - DNA, 25 bp, Homo sapiens
gacctttgccagcagccttgccgcg

SEQ ID NO: 11256 - DNA, 25 bp, Homo sapiens
acctttgccagcagccttgccgcgg

SEQ ID NO: 11257 - DNA, 25 bp, Homo sapiens
cctttgccagcagccttgccgcggt

SEQ ID NO: 11258 - DNA, 25 bp, Homo sapiens
ctttgccagcagccttgccgcggtg

SEQ ID NO: 11259 - DNA, 25 bp, Homo sapiens
tttgccagcagccttgccgcggtga

SEQ ID NO: 11260 - DNA, 25 bp, Homo sapiens
ttgccagcagccttgccgcggtgag

SEQ ID NO: 11261 - DNA, 25 bp, Homo sapiens
tgccagcagccttgccgcggtgagg

SEQ ID NO: 11262 - DNA, 25 bp, Homo sapiens
gccagcagccttgccgcggtgagga

SEQ ID NO: 11263 - DNA, 25 bp, Homo sapiens
ccagcagccttgccgcggtgaggag

SEQ ID NO: 11264 - DNA, 25 bp, Homo sapiens
cagcagccttgccgcggtgaggagg

SEQ ID NO: 11265 - DNA, 25 bp, Homo sapiens
agcagccttgccgcggtgaggagga

SEQ ID NO: 11266 - DNA, 25 bp, Homo sapiens
gcagccttgccgcggtgaggaggaa

SEQ ID NO: 11267 - DNA, 25 bp, Homo sapiens
cagccttgccgcggtgaggaggaaa

SEQ ID NO: 11268 - DNA, 25 bp, Homo sapiens
agccttgccgcggtgaggaggaaag

SEQ ID NO: 11269 - DNA, 25 bp, Homo sapiens
gccttgccgcggtgaggaggaaagc

SEQ ID NO: 11270 - DNA, 25 bp, Homo sapiens
ccttgccgcggtgaggaggaaagcc

SEQ ID NO: 11271 - DNA, 25 bp, Homo sapiens
cttgccgcggtgaggaggaaagccc

SEQ ID NO: 11272 - DNA, 25 bp, Homo sapiens
ttgccgcggtgaggaggaaagcccc

SEQ ID NO: 11273 - DNA, 25 bp, Homo sapiens
tgccgcggtgaggaggaaagccccg

SEQ ID NO: 11274 - DNA, 25 bp, Homo sapiens
gccgcggtgaggaggaaagccccgt

SEQ ID NO: 11275 - DNA, 25 bp, Homo sapiens
ccgcggtgaggaggaaagccccgtg

SEQ ID NO: 11276 - DNA, 25 bp, Homo sapiens
cgcggtgaggaggaaagccccgtgc

SEQ ID NO: 11277 - DNA, 25 bp, Homo sapiens
gcggtgaggaggaaagccccgtgct

SEQ ID NO: 11278 - DNA, 25 bp, Homo sapiens
cggtgaggaggaaagccccgtgctc

SEQ ID NO: 11279 - DNA, 25 bp, Homo sapiens
ggtgaggaggaaagccccgtgctcc

SEQ ID NO: 11280 - DNA, 25 bp, Homo sapiens
gtgaggaggaaagccccgtgctccc

SEQ ID NO: 11281 - DNA, 25 bp, Homo sapiens
tgaggaggaaagccccgtgctccca

SEQ ID NO: 11282 - DNA, 25 bp, Homo sapiens
gaggaggaaagccccgtgctcccag

SEQ ID NO: 11283 - DNA, 25 bp, Homo sapiens
aggaggaaagccccgtgctcccaga

SEQ ID NO: 11284 - DNA, 25 bp, Homo sapiens
ggaggaaagccccgtgctcccagat

SEQ ID NO: 11285 - DNA, 25 bp, Homo sapiens
gaggaaagccccgtgctcccagatc

SEQ ID NO: 11286 - DNA, 25 bp, Homo sapiens
aggaaagccccgtgctcccagatca

SEQ ID NO: 11287 - DNA, 25 bp, Homo sapiens
ggaaagccccgtgctcccagatcaa

SEQ ID NO: 11288 - DNA, 25 bp, Homo sapiens
gaaagccccgtgctcccagatcaag

SEQ ID NO: 11289 - DNA, 25 bp, Homo sapiens
aaagccccgtgctcccagatcaagc

SEQ ID NO: 11290 - DNA, 25 bp, Homo sapiens
aagccccgtgctcccagatcaagct

SEQ ID NO: 11291 - DNA, 25 bp, Homo sapiens
agccccgtgctcccagatcaagctg

SEQ ID NO: 11292 - DNA, 25 bp, Homo sapiens
gccccgtgctcccagatcaagctgc

SEQ ID NO: 11293 - DNA, 25 bp, Homo sapiens
ccccgtgctcccagatcaagctgca

SEQ ID NO: 11294 - DNA, 25 bp, Homo sapiens
cccgtgctcccagatcaagctgcag

SEQ ID NO: 11295 - DNA, 25 bp, Homo sapiens
ccgtgctcccagatcaagctgcaga

SEQ ID NO: 11296 - DNA, 25 bp, Homo sapiens
cgtgctcccagatcaagctgcagat

SEQ ID NO: 11297 - DNA, 25 bp, Homo sapiens
gtgctcccagatcaagctgcagatg

SEQ ID NO: 11298 - DNA, 25 bp, Homo sapiens
tgctcccagatcaagctgcagatgg

SEQ ID NO: 11299 - DNA, 25 bp, Homo sapiens
gctcccagatcaagctgcagatgga

SEQ ID NO: 11300 - DNA, 25 bp, Homo sapiens
ctcccagatcaagctgcagatggat

SEQ ID NO: 11301 - DNA, 25 bp, Homo sapiens
tcccagatcaagctgcagatggatg

SEQ ID NO: 11302 - DNA, 25 bp, Homo sapiens
cccagatcaagctgcagatggatgc

SEQ ID NO: 11303 - DNA, 25 bp, Homo sapiens
ccagatcaagctgcagatggatgcg

SEQ ID NO: 11304 - DNA, 25 bp, Homo sapiens
cagatcaagctgcagatggatgcgc

SEQ ID NO: 11305 - DNA, 25 bp, Homo sapiens
agatcaagctgcagatggatgcgct

SEQ ID NO: 11306 - DNA, 25 bp, Homo sapiens
gatcaagctgcagatggatgcgctg

SEQ ID NO: 11307 - DNA, 25 bp, Homo sapiens
atcaagctgcagatggatgcgctga

SEQ ID NO: 11308 - DNA, 25 bp, Homo sapiens
tcaagctgcagatggatgcgctgac

SEQ ID NO: 11309 - DNA, 25 bp, Homo sapiens
caagctgcagatggatgcgctgacc

SEQ ID NO: 11310 - DNA, 25 bp, Homo sapiens
aagctgcagatggatgcgctgacca

SEQ ID NO: 11311 - DNA, 25 bp, Homo sapiens
agctgcagatggatgcgctgaccag

SEQ ID NO: 11312 - DNA, 25 bp, Homo sapiens
gctgcagatggatgcgctgaccagc

SEQ ID NO: 11313 - DNA, 25 bp, Homo sapiens
ctgcagatggatgcgctgaccagca

SEQ ID NO: 11314 - DNA, 25 bp, Homo sapiens
tgcagatggatgcgctgaccagcat

SEQ ID NO: 11315 - DNA, 25 bp, Homo sapiens
gcagatggatgcgctgaccagcatg

SEQ ID NO: 11316 - DNA, 25 bp, Homo sapiens
cagatggatgcgctgaccagcatga

SEQ ID NO: 11317 - DNA, 25 bp, Homo sapiens
agatggatgcgctgaccagcatgat

SEQ ID NO: 11318 - DNA, 25 bp, Homo sapiens
gatggatgcgctgaccagcatgatc

SEQ ID NO: 11319 - DNA, 25 bp, Homo sapiens
atggatgcgctgaccagcatgatca

SEQ ID NO: 11320 - DNA, 25 bp, Homo sapiens
tggatgcgctgaccagcatgatcaa

SEQ ID NO: 11321 - DNA, 25 bp, Homo sapiens
ggatgcgctgaccagcatgatcaaa

SEQ ID NO: 11322 - DNA, 25 bp, Homo sapiens
gatgcgctgaccagcatgatcaaaa

SEQ ID NO: 11323 - DNA, 25 bp, Homo sapiens
atgcgctgaccagcatgatcaaaag

SEQ ID NO: 11324 - DNA, 25 bp, Homo sapiens
tgcgctgaccagcatgatcaaaagg

SEQ ID NO: 11325 - DNA, 25 bp, Homo sapiens
gcgctgaccagcatgatcaaaaggt

SEQ ID NO: 11326 - DNA, 25 bp, Homo sapiens
cgctgaccagcatgatcaaaaggtc

SEQ ID NO: 11327 - DNA, 25 bp, Homo sapiens
gctgaccagcatgatcaaaaggtcc

SEQ ID NO: 11328 - DNA, 25 bp, Homo sapiens
ctgaccagcatgatcaaaaggtccc

SEQ ID NO: 11329 - DNA, 25 bp, Homo sapiens
tgaccagcatgatcaaaaggtcccg

SEQ ID NO: 11330 - DNA, 25 bp, Homo sapiens
gaccagcatgatcaaaaggtcccgg

SEQ ID NO: 11331 - DNA, 25 bp, Homo sapiens
accagcatgatcaaaaggtcccggc

SEQ ID NO: 11332 - DNA, 25 bp, Homo sapiens
ccagcatgatcaaaaggtcccggct

SEQ ID NO: 11333 - DNA, 25 bp, Homo sapiens
cagcatgatcaaaaggtcccggctg

SEQ ID NO: 11334 - DNA, 25 bp, Homo sapiens
agcatgatcaaaaggtcccggctgc

SEQ ID NO: 11335 - DNA, 25 bp, Homo sapiens
gcatgatcaaaaggtcccggctgca

SEQ ID NO: 11336 - DNA, 25 bp, Homo sapiens
catgatcaaaaggtcccggctgcac

SEQ ID NO: 11337 - DNA, 25 bp, Homo sapiens
atgatcaaaaggtcccggctgcact

SEQ ID NO: 11338 - DNA, 25 bp, Homo sapiens
tgatcaaaaggtcccggctgcactt

SEQ ID NO: 11339 - DNA, 25 bp, Homo sapiens
gatcaaaaggtcccggctgcacttt

SEQ ID NO: 11340 - DNA, 25 bp, Homo sapiens
atcaaaaggtcccggctgcacttta

SEQ ID NO: 11341 - DNA, 25 bp, Homo sapiens
tcaaaaggtcccggctgcactttat

SEQ ID NO: 11342 - DNA, 25 bp, Homo sapiens
caaaaggtcccggctgcactttatc

SEQ ID NO: 11343 - DNA, 25 bp, Homo sapiens
aaaaggtcccggctgcactttatcc

SEQ ID NO: 11344 - DNA, 25 bp, Homo sapiens
aaaggtcccggctgcactttatcca

SEQ ID NO: 11345 - DNA, 25 bp, Homo sapiens
aaggtcccggctgcactttatccac

SEQ ID NO: 11346 - DNA, 25 bp, Homo sapiens
aggtcccggctgcactttatccact

SEQ ID NO: 11347 - DNA, 25 bp, Homo sapiens
ggtcccggctgcactttatccactg

SEQ ID NO: 11348 - DNA, 25 bp, Homo sapiens
gtcccggctgcactttatccactgc

SEQ ID NO: 11349 - DNA, 25 bp, Homo sapiens
tcccggctgcactttatccactgcc

SEQ ID NO: 11350 - DNA, 25 bp, Homo sapiens
cccggctgcactttatccactgcct

SEQ ID NO: 11351 - DNA, 25 bp, Homo sapiens
ccggctgcactttatccactgcctg

SEQ ID NO: 11352 - DNA, 25 bp, Homo sapiens
cggctgcactttatccactgcctgg

SEQ ID NO: 11353 - DNA, 25 bp, Homo sapiens
ggctgcactttatccactgcctggt

SEQ ID NO: 11354 - DNA, 25 bp, Homo sapiens
gctgcactttatccactgcctggta

SEQ ID NO: 11355 - DNA, 25 bp, Homo sapiens
ctgcactttatccactgcctggtac

SEQ ID NO: 11356 - DNA, 25 bp, Homo sapiens
tgcactttatccactgcctggtacc

SEQ ID NO: 11357 - DNA, 25 bp, Homo sapiens
gcactttatccactgcctggtacca

SEQ ID NO: 11358 - DNA, 25 bp, Homo sapiens
cactttatccactgcctggtaccaa

SEQ ID NO: 11359 - DNA, 25 bp, Homo sapiens
actttatccactgcctggtaccaaa

SEQ ID NO: 11360 - DNA, 25 bp, Homo sapiens
ctttatccactgcctggtaccaaac

SEQ ID NO: 11361 - DNA, 25 bp, Homo sapiens
tttatccactgcctggtaccaaacc

SEQ ID NO: 11362 - DNA, 25 bp, Homo sapiens
ttatccactgcctggtaccaaaccc

SEQ ID NO: 11363 - DNA, 25 bp, Homo sapiens
tatccactgcctggtaccaaaccct

SEQ ID NO: 11364 - DNA, 25 bp, Homo sapiens
atccactgcctggtaccaaaccctg

SEQ ID NO: 11365 - DNA, 25 bp, Homo sapiens
tccactgcctggtaccaaaccctgt

SEQ ID NO: 11366 - DNA, 25 bp, Homo sapiens
ccactgcctggtaccaaaccctgtg

SEQ ID NO: 11367 - DNA, 25 bp, Homo sapiens
cactgcctggtaccaaaccctgtgg

SEQ ID NO: 11368 - DNA, 25 bp, Homo sapiens
actgcctggtaccaaaccctgtggt

SEQ ID NO: 11369 - DNA, 25 bp, Homo sapiens
ctgcctggtaccaaaccctgtggtg

SEQ ID NO: 11370 - DNA, 25 bp, Homo sapiens
tgcctggtaccaaaccctgtggtgg

SEQ ID NO: 11371 - DNA, 25 bp, Homo sapiens
gcctggtaccaaaccctgtggtgga

SEQ ID NO: 11372 - DNA, 25 bp, Homo sapiens
cctggtaccaaaccctgtggtggaa

SEQ ID NO: 11373 - DNA, 25 bp, Homo sapiens
ctggtaccaaaccctgtggtggaaa

SEQ ID NO: 11374 - DNA, 25 bp, Homo sapiens
tggtaccaaaccctgtggtggaaag

SEQ ID NO: 11375 - DNA, 25 bp, Homo sapiens
ggtaccaaaccctgtggtggaaagc

SEQ ID NO: 11376 - DNA, 25 bp, Homo sapiens
gtaccaaaccctgtggtggaaagca

SEQ ID NO: 11377 - DNA, 25 bp, Homo sapiens
taccaaaccctgtggtggaaagcag

SEQ ID NO: 11378 - DNA, 25 bp, Homo sapiens
accaaaccctgtggtggaaagcagg

SEQ ID NO: 11379 - DNA, 25 bp, Homo sapiens
ccaaaccctgtggtggaaagcagga

SEQ ID NO: 11380 - DNA, 25 bp, Homo sapiens
caaaccctgtggtggaaagcaggag

SEQ ID NO: 11381 - DNA, 25 bp, Homo sapiens
aaaccctgtggtggaaagcaggagt

SEQ ID NO: 11382 - DNA, 25 bp, Homo sapiens
aaccctgtggtggaaagcaggagtg

SEQ ID NO: 11383 - DNA, 25 bp, Homo sapiens
accctgtggtggaaagcaggagtgg

SEQ ID NO: 11384 - DNA, 25 bp, Homo sapiens
ccctgtggtggaaagcaggagtggg

SEQ ID NO: 11385 - DNA, 25 bp, Homo sapiens
cctgtggtggaaagcaggagtgggc

SEQ ID NO: 11386 - DNA, 25 bp, Homo sapiens
ctgtggtggaaagcaggagtgggca

SEQ ID NO: 11387 - DNA, 25 bp, Homo sapiens
tgtggtggaaagcaggagtgggcag

SEQ ID NO: 11388 - DNA, 25 bp, Homo sapiens
gtggtggaaagcaggagtgggcagg

SEQ ID NO: 11389 - DNA, 25 bp, Homo sapiens
tggtggaaagcaggagtgggcagga

SEQ ID NO: 11390 - DNA, 25 bp, Homo sapiens
ggtggaaagcaggagtgggcaggaa

SEQ ID NO: 11391 - DNA, 25 bp, Homo sapiens
gtggaaagcaggagtgggcaggaat

SEQ ID NO: 11392 - DNA, 25 bp, Homo sapiens
tggaaagcaggagtgggcaggaatc

SEQ ID NO: 11393 - DNA, 25 bp, Homo sapiens
ggaaagcaggagtgggcaggaatct

SEQ ID NO: 11394 - DNA, 25 bp, Homo sapiens
gaaagcaggagtgggcaggaatctc

SEQ ID NO: 11395 - DNA, 25 bp, Homo sapiens
aaagcaggagtgggcaggaatctcc

SEQ ID NO: 11396 - DNA, 25 bp, Homo sapiens
aagcaggagtgggcaggaatctcca

SEQ ID NO: 11397 - DNA, 25 bp, Homo sapiens
agcaggagtgggcaggaatctccac

SEQ ID NO: 11398 - DNA, 25 bp, Homo sapiens
gcaggagtgggcaggaatctccacc

SEQ ID NO: 11399 - DNA, 25 bp, Homo sapiens
caggagtgggcaggaatctccacca

SEQ ID NO: 11400 - DNA, 25 bp, Homo sapiens
aggagtgggcaggaatctccaccac

SEQ ID NO: 11401 - DNA, 25 bp, Homo sapiens
ggagtgggcaggaatctccaccacc

SEQ ID NO: 11402 - DNA, 25 bp, Homo sapiens
gagtgggcaggaatctccaccacca

SEQ ID NO: 11403 - DNA, 25 bp, Homo sapiens
agtgggcaggaatctccaccaccac

SEQ ID NO: 11404 - DNA, 25 bp, Homo sapiens
gtgggcaggaatctccaccaccacc

SEQ ID NO: 11405 - DNA, 25 bp, Homo sapiens
tgggcaggaatctccaccaccaccg

SEQ ID NO: 11406 - DNA, 25 bp, Homo sapiens
gggcaggaatctccaccaccaccgc

SEQ ID NO: 11407 - DNA, 25 bp, Homo sapiens
ggcaggaatctccaccaccaccgca

SEQ ID NO: 11408 - DNA, 25 bp, Homo sapiens
gcaggaatctccaccaccaccgcag

SEQ ID NO: 11409 - DNA, 25 bp, Homo sapiens
caggaatctccaccaccaccgcagc

SEQ ID NO: 11410 - DNA, 25 bp, Homo sapiens
aggaatctccaccaccaccgcagcc

SEQ ID NO: 11411 - DNA, 25 bp, Homo sapiens
ggaatctccaccaccaccgcagcct

SEQ ID NO: 11412 - DNA, 25 bp, Homo sapiens
gaatctccaccaccaccgcagcctg

SEQ ID NO: 11413 - DNA, 25 bp, Homo sapiens
aatctccaccaccaccgcagcctgg

SEQ ID NO: 11414 - DNA, 25 bp, Homo sapiens
atctccaccaccaccgcagcctggt

SEQ ID NO: 11415 - DNA, 25 bp, Homo sapiens
tctccaccaccaccgcagcctggta

SEQ ID NO: 11416 - DNA, 25 bp, Homo sapiens
ctccaccaccaccgcagcctggtag

SEQ ID NO: 11417 - DNA, 25 bp, Homo sapiens
tccaccaccaccgcagcctggtaga

SEQ ID NO: 11418 - DNA, 25 bp, Homo sapiens
ccaccaccaccgcagcctggtagag

SEQ ID NO: 11419 - DNA, 25 bp, Homo sapiens
caccaccaccgcagcctggtagaga

SEQ ID NO: 11420 - DNA, 25 bp, Homo sapiens
accaccaccgcagcctggtagagac

SEQ ID NO: 11421 - DNA, 25 bp, Homo sapiens
ccaccaccgcagcctggtagagaca

SEQ ID NO: 11422 - DNA, 25 bp, Homo sapiens
caccaccgcagcctggtagagacaa

SEQ ID NO: 11423 - DNA, 25 bp, Homo sapiens
accaccgcagcctggtagagacaag

SEQ ID NO: 11424 - DNA, 25 bp, Homo sapiens
ccaccgcagcctggtagagacaagc

SEQ ID NO: 11425 - DNA, 25 bp, Homo sapiens
caccgcagcctggtagagacaagcc

SEQ ID NO: 11426 - DNA, 25 bp, Homo sapiens
accgcagcctggtagagacaagcct

SEQ ID NO: 11427 - DNA, 25 bp, Homo sapiens
ccgcagcctggtagagacaagcctg

SEQ ID NO: 11428 - DNA, 25 bp, Homo sapiens
cgcagcctggtagagacaagcctgg

SEQ ID NO: 11429 - DNA, 25 bp, Homo sapiens
gcagcctggtagagacaagcctggg

SEQ ID NO: 11430 - DNA, 25 bp, Homo sapiens
cagcctggtagagacaagcctgggg

SEQ ID NO: 11431 - DNA, 25 bp, Homo sapiens
agcctggtagagacaagcctggggc

SEQ ID NO: 11432 - DNA, 25 bp, Homo sapiens
gcctggtagagacaagcctggggca

SEQ ID NO: 11433 - DNA, 25 bp, Homo sapiens
cctggtagagacaagcctggggcag

SEQ ID NO: 11434 - DNA, 25 bp, Homo sapiens
ctggtagagacaagcctggggcagg

SEQ ID NO: 11435 - DNA, 25 bp, Homo sapiens
tggtagagacaagcctggggcaggt

SEQ ID NO: 11436 - DNA, 25 bp, Homo sapiens
ggtagagacaagcctggggcaggtg

SEQ ID NO: 11437 - DNA, 25 bp, Homo sapiens
gtagagacaagcctggggcaggtgg

SEQ ID NO: 11438 - DNA, 25 bp, Homo sapiens
tagagacaagcctggggcaggtgga

SEQ ID NO: 11439 - DNA, 25 bp, Homo sapiens
agagacaagcctggggcaggtggac

SEQ ID NO: 11440 - DNA, 25 bp, Homo sapiens
gagacaagcctggggcaggtggacc

SEQ ID NO: 11441 - DNA, 25 bp, Homo sapiens
agacaagcctggggcaggtggacct

SEQ ID NO: 11442 - DNA, 25 bp, Homo sapiens
gacaagcctggggcaggtggacctc

SEQ ID NO: 11443 - DNA, 25 bp, Homo sapiens
acaagcctggggcaggtggacctct

SEQ ID NO: 11444 - DNA, 25 bp, Homo sapiens
caagcctggggcaggtggacctctg

SEQ ID NO: 11445 - DNA, 25 bp, Homo sapiens
aagcctggggcaggtggacctctgg

SEQ ID NO: 11446 - DNA, 25 bp, Homo sapiens
agcctggggcaggtggacctctggc

SEQ ID NO: 11447 - DNA, 25 bp, Homo sapiens
gcctggggcaggtggacctctggcc

SEQ ID NO: 11448 - DNA, 25 bp, Homo sapiens
cctggggcaggtggacctctggccc

SEQ ID NO: 11449 - DNA, 25 bp, Homo sapiens
ctggggcaggtggacctctggccct

SEQ ID NO: 11450 - DNA, 25 bp, Homo sapiens
tggggcaggtggacctctggccctg

SEQ ID NO: 11451 - DNA, 25 bp, Homo sapiens
ggggcaggtggacctctggccctgg

SEQ ID NO: 11452 - DNA, 25 bp, Homo sapiens
gggcaggtggacctctggccctgga

SEQ ID NO: 11453 - DNA, 25 bp, Homo sapiens
ggcaggtggacctctggccctggat

SEQ ID NO: 11454 - DNA, 25 bp, Homo sapiens
gcaggtggacctctggccctggata

SEQ ID NO: 11455 - DNA, 25 bp, Homo sapiens
caggtggacctctggccctggatat

SEQ ID NO: 11456 - DNA, 25 bp, Homo sapiens
aggtggacctctggccctggatatc

SEQ ID NO: 11457 - DNA, 25 bp, Homo sapiens
ggtggacctctggccctggatatcc

SEQ ID NO: 11458 - DNA, 25 bp, Homo sapiens
gtggacctctggccctggatatccc

SEQ ID NO: 11459 - DNA, 25 bp, Homo sapiens
tggacctctggccctggatatccca

SEQ ID NO: 11460 - DNA, 25 bp, Homo sapiens
ggacctctggccctggatatcccag

SEQ ID NO: 11461 - DNA, 25 bp, Homo sapiens
gacctctggccctggatatcccagc

SEQ ID NO: 11462 - DNA, 25 bp, Homo sapiens
acctctggccctggatatcccagca

SEQ ID NO: 11463 - DNA, 25 bp, Homo sapiens
cctctggccctggatatcccagcac

SEQ ID NO: 11464 - DNA, 25 bp, Homo sapiens
ctctggccctggatatcccagcact

SEQ ID NO: 11465 - DNA, 25 bp, Homo sapiens
tctggccctggatatcccagcactg

SEQ ID NO: 11466 - DNA, 25 bp, Homo sapiens
ctggccctggatatcccagcactga

SEQ ID NO: 11467 - DNA, 25 bp, Homo sapiens
tggccctggatatcccagcactgag

SEQ ID NO: 11468 - DNA, 25 bp, Homo sapiens
ggccctggatatcccagcactgagg

SEQ ID NO: 11469 - DNA, 25 bp, Homo sapiens
gccctggatatcccagcactgaggg

SEQ ID NO: 11470 - DNA, 25 bp, Homo sapiens
ccctggatatcccagcactgagggt

SEQ ID NO: 11471 - DNA, 25 bp, Homo sapiens
cctggatatcccagcactgagggtc

SEQ ID NO: 11472 - DNA, 25 bp, Homo sapiens
ctggatatcccagcactgagggtcc

SEQ ID NO: 11473 - DNA, 25 bp, Homo sapiens
tggatatcccagcactgagggtcca

SEQ ID NO: 11474 - DNA, 25 bp, Homo sapiens
ggatatcccagcactgagggtccag

SEQ ID NO: 11475 - DNA, 25 bp, Homo sapiens
gatatcccagcactgagggtccagc

SEQ ID NO: 11476 - DNA, 25 bp, Homo sapiens
atatcccagcactgagggtccagct

SEQ ID NO: 11477 - DNA, 25 bp, Homo sapiens
tatcccagcactgagggtccagctt

SEQ ID NO: 11478 - DNA, 25 bp, Homo sapiens
atcccagcactgagggtccagcttg

SEQ ID NO: 11479 - DNA, 25 bp, Homo sapiens
tcccagcactgagggtccagcttgc

SEQ ID NO: 11480 - DNA, 25 bp, Homo sapiens
cccagcactgagggtccagcttgct

SEQ ID NO: 11481 - DNA, 25 bp, Homo sapiens
ccagcactgagggtccagcttgctg

SEQ ID NO: 11482 - DNA, 25 bp, Homo sapiens
cagcactgagggtccagcttgctgg

SEQ ID NO: 11483 - DNA, 25 bp, Homo sapiens
agcactgagggtccagcttgctggg

SEQ ID NO: 11484 - DNA, 25 bp, Homo sapiens
gcactgagggtccagcttgctgggt

SEQ ID NO: 11485 - DNA, 25 bp, Homo sapiens
cactgagggtccagcttgctgggtt

SEQ ID NO: 11486 - DNA, 25 bp, Homo sapiens
actgagggtccagcttgctgggttc

SEQ ID NO: 11487 - DNA, 25 bp, Homo sapiens
ctgagggtccagcttgctgggttcc

SEQ ID NO: 11488 - DNA, 25 bp, Homo sapiens
tgagggtccagcttgctgggttcca

SEQ ID NO: 11489 - DNA, 25 bp, Homo sapiens
gagggtccagcttgctgggttccac

SEQ ID NO: 11490 - DNA, 25 bp, Homo sapiens
agggtccagcttgctgggttccaca

SEQ ID NO: 11491 - DNA, 25 bp, Homo sapiens
gggtccagcttgctgggttccacat

SEQ ID NO: 11492 - DNA, 25 bp, Homo sapiens
ggtccagcttgctgggttccacatc

SEQ ID NO: 11493 - DNA, 25 bp, Homo sapiens
gtccagcttgctgggttccacatcc

SEQ ID NO: 11494 - DNA, 25 bp, Homo sapiens
tccagcttgctgggttccacatcct

SEQ ID NO: 11495 - DNA, 25 bp, Homo sapiens
ccagcttgctgggttccacatcctg

SEQ ID NO: 11496 - DNA, 25 bp, Homo sapiens
cagcttgctgggttccacatcctgg

SEQ ID NO: 11497 - DNA, 25 bp, Homo sapiens
agcttgctgggttccacatcctgga

SEQ ID NO: 11498 - DNA, 25 bp, Homo sapiens
gcttgctgggttccacatcctggag

SEQ ID NO: 11499 - DNA, 25 bp, Homo sapiens
cttgctgggttccacatcctggagg

SEQ ID NO: 11500 - DNA, 25 bp, Homo sapiens
ttgctgggttccacatcctggaggc

SEQ ID NO: 11501 - DNA, 25 bp, Homo sapiens
tgctgggttccacatcctggaggct

SEQ ID NO: 11502 - DNA, 25 bp, Homo sapiens
gctgggttccacatcctggaggctc

SEQ ID NO: 11503 - DNA, 25 bp, Homo sapiens
ctgggttccacatcctggaggctct

SEQ ID NO: 11504 - DNA, 25 bp, Homo sapiens
tgggttccacatcctggaggctctg

SEQ ID NO: 11505 - DNA, 25 bp, Homo sapiens
gggttccacatcctggaggctctgc

SEQ ID NO: 11506 - DNA, 25 bp, Homo sapiens
ggttccacatcctggaggctctgcg

SEQ ID NO: 11507 - DNA, 25 bp, Homo sapiens
gttccacatcctggaggctctgcgt

SEQ ID NO: 11508 - DNA, 25 bp, Homo sapiens
ttccacatcctggaggctctgcgtc

SEQ ID NO: 11509 - DNA, 25 bp, Homo sapiens
tccacatcctggaggctctgcgtct

SEQ ID NO: 11510 - DNA, 25 bp, Homo sapiens
ccacatcctggaggctctgcgtctg

SEQ ID NO: 11511 - DNA, 25 bp, Homo sapiens
cacatcctggaggctctgcgtctgc

SEQ ID NO: 11512 - DNA, 25 bp, Homo sapiens
acatcctggaggctctgcgtctgca

SEQ ID NO: 11513 - DNA, 25 bp, Homo sapiens
catcctggaggctctgcgtctgcat

SEQ ID NO: 11514 - DNA, 25 bp, Homo sapiens
atcctggaggctctgcgtctgcata

SEQ ID NO: 11515 - DNA, 25 bp, Homo sapiens
tcctggaggctctgcgtctgcatag

SEQ ID NO: 11516 - DNA, 25 bp, Homo sapiens
cctggaggctctgcgtctgcatagg

SEQ ID NO: 11517 - DNA, 25 bp, Homo sapiens
ctggaggctctgcgtctgcatagga

SEQ ID NO: 11518 - DNA, 25 bp, Homo sapiens
tggaggctctgcgtctgcataggac

SEQ ID NO: 11519 - DNA, 25 bp, Homo sapiens
ggaggctctgcgtctgcataggaca

SEQ ID NO: 11520 - DNA, 25 bp, Homo sapiens
gaggctctgcgtctgcataggacag

SEQ ID NO: 11521 - DNA, 25 bp, Homo sapiens
aggctctgcgtctgcataggacagg

SEQ ID NO: 11522 - DNA, 25 bp, Homo sapiens
ggctctgcgtctgcataggacaggc

SEQ ID NO: 11523 - DNA, 25 bp, Homo sapiens
gctctgcgtctgcataggacaggct

SEQ ID NO: 11524 - DNA, 25 bp, Homo sapiens
ctctgcgtctgcataggacaggcta

SEQ ID NO: 11525 - DNA, 25 bp, Homo sapiens
tctgcgtctgcataggacaggctat

SEQ ID NO: 11526 - DNA, 25 bp, Homo sapiens
ctgcgtctgcataggacaggctatg

SEQ ID NO: 11527 - DNA, 25 bp, Homo sapiens
tgcgtctgcataggacaggctatgc

SEQ ID NO: 11528 - DNA, 25 bp, Homo sapiens
gcgtctgcataggacaggctatgct

SEQ ID NO: 11529 - DNA, 25 bp, Homo sapiens
cgtctgcataggacaggctatgctg

SEQ ID NO: 11530 - DNA, 25 bp, Homo sapiens
gtctgcataggacaggctatgctga

SEQ ID NO: 11531 - DNA, 25 bp, Homo sapiens
tctgcataggacaggctatgctgac

SEQ ID NO: 11532 - DNA, 25 bp, Homo sapiens
ctgcataggacaggctatgctgacc

SEQ ID NO: 11533 - DNA, 25 bp, Homo sapiens
tgcataggacaggctatgctgacca

SEQ ID NO: 11534 - DNA, 25 bp, Homo sapiens
gcataggacaggctatgctgaccac

SEQ ID NO: 11535 - DNA, 25 bp, Homo sapiens
cataggacaggctatgctgaccaca

SEQ ID NO: 11536 - DNA, 25 bp, Homo sapiens
ataggacaggctatgctgaccacat

SEQ ID NO: 11537 - DNA, 25 bp, Homo sapiens
taggacaggctatgctgaccacatg

SEQ ID NO: 11538 - DNA, 25 bp, Homo sapiens
aggacaggctatgctgaccacatgg

SEQ ID NO: 11539 - DNA, 25 bp, Homo sapiens
ggacaggctatgctgaccacatggg

SEQ ID NO: 11540 - DNA, 25 bp, Homo sapiens
gacaggctatgctgaccacatgggg

SEQ ID NO: 11541 - DNA, 25 bp, Homo sapiens
acaggctatgctgaccacatggggc

SEQ ID NO: 11542 - DNA, 25 bp, Homo sapiens
caggctatgctgaccacatggggct

SEQ ID NO: 11543 - DNA, 25 bp, Homo sapiens
aggctatgctgaccacatggggctc

SEQ ID NO: 11544 - DNA, 25 bp, Homo sapiens
ggctatgctgaccacatggggctca

SEQ ID NO: 11545 - DNA, 25 bp, Homo sapiens
gctatgctgaccacatggggctcac

SEQ ID NO: 11546 - DNA, 25 bp, Homo sapiens
ctatgctgaccacatggggctcact

SEQ ID NO: 11547 - DNA, 25 bp, Homo sapiens
tatgctgaccacatggggctcactc

SEQ ID NO: 11548 - DNA, 25 bp, Homo sapiens
atgctgaccacatggggctcactcg

SEQ ID NO: 11549 - DNA, 25 bp, Homo sapiens
tgctgaccacatggggctcactcgc

SEQ ID NO: 11550 - DNA, 25 bp, Homo sapiens
gctgaccacatggggctcactcgct

SEQ ID NO: 11551 - DNA, 25 bp, Homo sapiens
ctgaccacatggggctcactcgctt

SEQ ID NO: 11552 - DNA, 25 bp, Homo sapiens
tgaccacatggggctcactcgcttc

SEQ ID NO: 11553 - DNA, 25 bp, Homo sapiens
gaccacatggggctcactcgcttcc

SEQ ID NO: 11554 - DNA, 25 bp, Homo sapiens
accacatggggctcactcgcttccg

SEQ ID NO: 11555 - DNA, 25 bp, Homo sapiens
ccacatggggctcactcgcttccgc

SEQ ID NO: 11556 - DNA, 25 bp, Homo sapiens
cacatggggctcactcgcttccgcc

SEQ ID NO: 11557 - DNA, 25 bp, Homo sapiens
acatggggctcactcgcttccgccg

SEQ ID NO: 11558 - DNA, 25 bp, Homo sapiens
catggggctcactcgcttccgccgg

SEQ ID NO: 11559 - DNA, 25 bp, Homo sapiens
atggggctcactcgcttccgccggc

SEQ ID NO: 11560 - DNA, 25 bp, Homo sapiens
tggggctcactcgcttccgccggca

SEQ ID NO: 11561 - DNA, 25 bp, Homo sapiens
ggggctcactcgcttccgccggcaa

SEQ ID NO: 11562 - DNA, 25 bp, Homo sapiens
gggctcactcgcttccgccggcaat

SEQ ID NO: 11563 - DNA, 25 bp, Homo sapiens
ggctcactcgcttccgccggcaatt

SEQ ID NO: 11564 - DNA, 25 bp, Homo sapiens
gctcactcgcttccgccggcaattc

SEQ ID NO: 11565 - DNA, 25 bp, Homo sapiens
ctcactcgcttccgccggcaattcc

SEQ ID NO: 11566 - DNA, 25 bp, Homo sapiens
tcactcgcttccgccggcaattcca

SEQ ID NO: 11567 - DNA, 25 bp, Homo sapiens
cactcgcttccgccggcaattccag

SEQ ID NO: 11568 - DNA, 25 bp, Homo sapiens
actcgcttccgccggcaattccagg

SEQ ID NO: 11569 - DNA, 25 bp, Homo sapiens
ctcgcttccgccggcaattccaggt

SEQ ID NO: 11570 - DNA, 25 bp, Homo sapiens
tcgcttccgccggcaattccaggtg

SEQ ID NO: 11571 - DNA, 25 bp, Homo sapiens
cgcttccgccggcaattccaggtgc

SEQ ID NO: 11572 - DNA, 25 bp, Homo sapiens
gcttccgccggcaattccaggtgct

SEQ ID NO: 11573 - DNA, 25 bp, Homo sapiens
cttccgccggcaattccaggtgctg

SEQ ID NO: 11574 - DNA, 25 bp, Homo sapiens
ttccgccggcaattccaggtgctgg

SEQ ID NO: 11575 - DNA, 25 bp, Homo sapiens
tccgccggcaattccaggtgctgga

SEQ ID NO: 11576 - DNA, 25 bp, Homo sapiens
ccgccggcaattccaggtgctggac

SEQ ID NO: 11577 - DNA, 25 bp, Homo sapiens
cgccggcaattccaggtgctggacg

SEQ ID NO: 11578 - DNA, 25 bp, Homo sapiens
gccggcaattccaggtgctggacgc

SEQ ID NO: 11579 - DNA, 25 bp, Homo sapiens
ccggcaattccaggtgctggacgct

SEQ ID NO: 11580 - DNA, 25 bp, Homo sapiens
cggcaattccaggtgctggacgctc

SEQ ID NO: 11581 - DNA, 25 bp, Homo sapiens
ggcaattccaggtgctggacgctcc

SEQ ID NO: 11582 - DNA, 25 bp, Homo sapiens
gcaattccaggtgctggacgctcca

SEQ ID NO: 11583 - DNA, 25 bp, Homo sapiens
caattccaggtgctggacgctccac

SEQ ID NO: 11584 - DNA, 25 bp, Homo sapiens
aattccaggtgctggacgctccact

SEQ ID NO: 11585 - DNA, 25 bp, Homo sapiens
attccaggtgctggacgctccactc

SEQ ID NO: 11586 - DNA, 25 bp, Homo sapiens
ttccaggtgctggacgctccactcc

SEQ ID NO: 11587 - DNA, 25 bp, Homo sapiens
tccaggtgctggacgctccactcct

SEQ ID NO: 11588 - DNA, 25 bp, Homo sapiens
ccaggtgctggacgctccactcctg

SEQ ID NO: 11589 - DNA, 25 bp, Homo sapiens
caggtgctggacgctccactcctga

SEQ ID NO: 11590 - DNA, 25 bp, Homo sapiens
aggtgctggacgctccactcctgaa

SEQ ID NO: 11591 - DNA, 25 bp, Homo sapiens
ggtgctggacgctccactcctgaag

SEQ ID NO: 11592 - DNA, 25 bp, Homo sapiens
gtgctggacgctccactcctgaaga

SEQ ID NO: 11593 - DNA, 25 bp, Homo sapiens
tgctggacgctccactcctgaagaa

SEQ ID NO: 11594 - DNA, 25 bp, Homo sapiens
gctggacgctccactcctgaagaag

SEQ ID NO: 11595 - DNA, 25 bp, Homo sapiens
ctggacgctccactcctgaagaagc

SEQ ID NO: 11596 - DNA, 25 bp, Homo sapiens
tggacgctccactcctgaagaagct

SEQ ID NO: 11597 - DNA, 25 bp, Homo sapiens
ggacgctccactcctgaagaagctc

SEQ ID NO: 11598 - DNA, 25 bp, Homo sapiens
gacgctccactcctgaagaagctca

SEQ ID NO: 11599 - DNA, 25 bp, Homo sapiens
acgctccactcctgaagaagctcat

SEQ ID NO: 11600 - DNA, 25 bp, Homo sapiens
cgctccactcctgaagaagctcatg

SEQ ID NO: 11601 - DNA, 25 bp, Homo sapiens
gctccactcctgaagaagctcatgt

SEQ ID NO: 11602 - DNA, 25 bp, Homo sapiens
ctccactcctgaagaagctcatgtc

SEQ ID NO: 11603 - DNA, 25 bp, Homo sapiens
tccactcctgaagaagctcatgtcg

SEQ ID NO: 11604 - DNA, 25 bp, Homo sapiens
ccactcctgaagaagctcatgtcga

SEQ ID NO: 11605 - DNA, 25 bp, Homo sapiens
cactcctgaagaagctcatgtcgac

SEQ ID NO: 11606 - DNA, 25 bp, Homo sapiens
actcctgaagaagctcatgtcgacc

SEQ ID NO: 11607 - DNA, 25 bp, Homo sapiens
ctcctgaagaagctcatgtcgacct

SEQ ID NO: 11608 - DNA, 25 bp, Homo sapiens
tcctgaagaagctcatgtcgacctc

SEQ ID NO: 11609 - DNA, 25 bp, Homo sapiens
cctgaagaagctcatgtcgacctcc

SEQ ID NO: 11610 - DNA, 25 bp, Homo sapiens
ctgaagaagctcatgtcgacctccg

SEQ ID NO: 11611 - DNA, 25 bp, Homo sapiens
tgaagaagctcatgtcgacctccga

SEQ ID NO: 11612 - DNA, 25 bp, Homo sapiens
gaagaagctcatgtcgacctccgag

SEQ ID NO: 11613 - DNA, 25 bp, Homo sapiens
aagaagctcatgtcgacctccgagg

SEQ ID NO: 11614 - DNA, 25 bp, Homo sapiens
agaagctcatgtcgacctccgaggg

SEQ ID NO: 11615 - DNA, 25 bp, Homo sapiens
gaagctcatgtcgacctccgaggga

SEQ ID NO: 11616 - DNA, 25 bp, Homo sapiens
aagctcatgtcgacctccgagggaa

SEQ ID NO: 11617 - DNA, 25 bp, Homo sapiens
agctcatgtcgacctccgagggaat

SEQ ID NO: 11618 - DNA, 25 bp, Homo sapiens
gctcatgtcgacctccgagggaata

SEQ ID NO: 11619 - DNA, 25 bp, Homo sapiens
ctcatgtcgacctccgagggaatag

SEQ ID NO: 11620 - DNA, 25 bp, Homo sapiens
tcatgtcgacctccgagggaataga

SEQ ID NO: 11621 - DNA, 25 bp, Homo sapiens
catgtcgacctccgagggaatagat

SEQ ID NO: 11622 - DNA, 25 bp, Homo sapiens
atgtcgacctccgagggaatagatg

SEQ ID NO: 11623 - DNA, 25 bp, Homo sapiens
tgtcgacctccgagggaatagatga

SEQ ID NO: 11624 - DNA, 25 bp, Homo sapiens
gtcgacctccgagggaatagatgaa

SEQ ID NO: 11625 - DNA, 25 bp, Homo sapiens
tcgacctccgagggaatagatgaaa

SEQ ID NO: 11626 - DNA, 25 bp, Homo sapiens
cgacctccgagggaatagatgaaag

SEQ ID NO: 11627 - DNA, 25 bp, Homo sapiens
gacctccgagggaatagatgaaagg

SEQ ID NO: 11628 - DNA, 25 bp, Homo sapiens
acctccgagggaatagatgaaagga

SEQ ID NO: 11629 - DNA, 25 bp, Homo sapiens
cctccgagggaatagatgaaaggaa

SEQ ID NO: 11630 - DNA, 25 bp, Homo sapiens
ctccgagggaatagatgaaaggaag

SEQ ID NO: 11631 - DNA, 25 bp, Homo sapiens
tccgagggaatagatgaaaggaagg

SEQ ID NO: 11632 - DNA, 25 bp, Homo sapiens
ccgagggaatagatgaaaggaaggc

SEQ ID NO: 11633 - DNA, 25 bp, Homo sapiens
cgagggaatagatgaaaggaaggcc

SEQ ID NO: 11634 - DNA, 25 bp, Homo sapiens
gagggaatagatgaaaggaaggccg

SEQ ID NO: 11635 - DNA, 25 bp, Homo sapiens
agggaatagatgaaaggaaggccgt

SEQ ID NO: 11636 - DNA, 25 bp, Homo sapiens
gggaatagatgaaaggaaggccgtg

SEQ ID NO: 11637 - DNA, 25 bp, Homo sapiens
ggaatagatgaaaggaaggccgtgg

SEQ ID NO: 11638 - DNA, 25 bp, Homo sapiens
gaatagatgaaaggaaggccgtgga

SEQ ID NO: 11639 - DNA, 25 bp, Homo sapiens
aatagatgaaaggaaggccgtggag

SEQ ID NO: 11640 - DNA, 25 bp, Homo sapiens
atagatgaaaggaaggccgtggagg

SEQ ID NO: 11641 - DNA, 25 bp, Homo sapiens
tagatgaaaggaaggccgtggagga

SEQ ID NO: 11642 - DNA, 25 bp, Homo sapiens
agatgaaaggaaggccgtggaggag

SEQ ID NO: 11643 - DNA, 25 bp, Homo sapiens
gatgaaaggaaggccgtggaggagc

SEQ ID NO: 11644 - DNA, 25 bp, Homo sapiens
atgaaaggaaggccgtggaggagct

SEQ ID NO: 11645 - DNA, 25 bp, Homo sapiens
tgaaaggaaggccgtggaggagctc

SEQ ID NO: 11646 - DNA, 25 bp, Homo sapiens
gaaaggaaggccgtggaggagctcc

SEQ ID NO: 11647 - DNA, 25 bp, Homo sapiens
aaaggaaggccgtggaggagctcct

SEQ ID NO: 11648 - DNA, 25 bp, Homo sapiens
aaggaaggccgtggaggagctcctg

SEQ ID NO: 11649 - DNA, 25 bp, Homo sapiens
aggaaggccgtggaggagctcctgg

SEQ ID NO: 11650 - DNA, 25 bp, Homo sapiens
ggaaggccgtggaggagctcctgga

SEQ ID NO: 11651 - DNA, 25 bp, Homo sapiens
gaaggccgtggaggagctcctggag

SEQ ID NO: 11652 - DNA, 25 bp, Homo sapiens
aaggccgtggaggagctcctggaga

SEQ ID NO: 11653 - DNA, 25 bp, Homo sapiens
aggccgtggaggagctcctggagac

SEQ ID NO: 11654 - DNA, 25 bp, Homo sapiens
ggccgtggaggagctcctggagacc

SEQ ID NO: 11655 - DNA, 25 bp, Homo sapiens
gccgtggaggagctcctggagaccc

SEQ ID NO: 11656 - DNA, 25 bp, Homo sapiens
ccgtggaggagctcctggagaccct

SEQ ID NO: 11657 - DNA, 25 bp, Homo sapiens
cgtggaggagctcctggagaccctg

SEQ ID NO: 11658 - DNA, 25 bp, Homo sapiens
gtggaggagctcctggagaccctgg

SEQ ID NO: 11659 - DNA, 25 bp, Homo sapiens
tggaggagctcctggagaccctgga

SEQ ID NO: 11660 - DNA, 25 bp, Homo sapiens
ggaggagctcctggagaccctggat

SEQ ID NO: 11661 - DNA, 25 bp, Homo sapiens
gaggagctcctggagaccctggatc

SEQ ID NO: 11662 - DNA, 25 bp, Homo sapiens
aggagctcctggagaccctggatct

SEQ ID NO: 11663 - DNA, 25 bp, Homo sapiens
ggagctcctggagaccctggatctg

SEQ ID NO: 11664 - DNA, 25 bp, Homo sapiens
gagctcctggagaccctggatctgg

SEQ ID NO: 11665 - DNA, 25 bp, Homo sapiens
agctcctggagaccctggatctgga

SEQ ID NO: 11666 - DNA, 25 bp, Homo sapiens
gctcctggagaccctggatctggaa

SEQ ID NO: 11667 - DNA, 25 bp, Homo sapiens
ctcctggagaccctggatctggaaa

SEQ ID NO: 11668 - DNA, 25 bp, Homo sapiens
tcctggagaccctggatctggaaaa

SEQ ID NO: 11669 - DNA, 25 bp, Homo sapiens
cctggagaccctggatctggaaaag

SEQ ID NO: 11670 - DNA, 25 bp, Homo sapiens
ctggagaccctggatctggaaaaga

SEQ ID NO: 11671 - DNA, 25 bp, Homo sapiens
tggagaccctggatctggaaaagaa

SEQ ID NO: 11672 - DNA, 25 bp, Homo sapiens
ggagaccctggatctggaaaagaag

SEQ ID NO: 11673 - DNA, 25 bp, Homo sapiens
gagaccctggatctggaaaagaagg

SEQ ID NO: 11674 - DNA, 25 bp, Homo sapiens
agaccctggatctggaaaagaaggc

SEQ ID NO: 11675 - DNA, 25 bp, Homo sapiens
gaccctggatctggaaaagaaggcg

SEQ ID NO: 11676 - DNA, 25 bp, Homo sapiens
accctggatctggaaaagaaggcgg

SEQ ID NO: 11677 - DNA, 25 bp, Homo sapiens
ccctggatctggaaaagaaggcggt

SEQ ID NO: 11678 - DNA, 25 bp, Homo sapiens
cctggatctggaaaagaaggcggtg

SEQ ID NO: 11679 - DNA, 25 bp, Homo sapiens
ctggatctggaaaagaaggcggtgg

SEQ ID NO: 11680 - DNA, 25 bp, Homo sapiens
tggatctggaaaagaaggcggtggc

SEQ ID NO: 11681 - DNA, 25 bp, Homo sapiens
ggatctggaaaagaaggcggtggct

SEQ ID NO: 11682 - DNA, 25 bp, Homo sapiens
gatctggaaaagaaggcggtggctg

SEQ ID NO: 11683 - DNA, 25 bp, Homo sapiens
atctggaaaagaaggcggtggctgt

SEQ ID NO: 11684 - DNA, 25 bp, Homo sapiens
tctggaaaagaaggcggtggctgtg

SEQ ID NO: 11685 - DNA, 25 bp, Homo sapiens
ctggaaaagaaggcggtggctgtgg

SEQ ID NO: 11686 - DNA, 25 bp, Homo sapiens
tggaaaagaaggcggtggctgtggg

SEQ ID NO: 11687 - DNA, 25 bp, Homo sapiens
ggaaaagaaggcggtggctgtgggg

SEQ ID NO: 11688 - DNA, 25 bp, Homo sapiens
gaaaagaaggcggtggctgtggggc

SEQ ID NO: 11689 - DNA, 25 bp, Homo sapiens
aaaagaaggcggtggctgtggggca

SEQ ID NO: 11690 - DNA, 25 bp, Homo sapiens
aaagaaggcggtggctgtggggcac

SEQ ID NO: 11691 - DNA, 25 bp, Homo sapiens
aagaaggcggtggctgtggggcaca

SEQ ID NO: 11692 - DNA, 25 bp, Homo sapiens
agaaggcggtggctgtggggcacag

SEQ ID NO: 11693 - DNA, 25 bp, Homo sapiens
gaaggcggtggctgtggggcacagc

SEQ ID NO: 11694 - DNA, 25 bp, Homo sapiens
aaggcggtggctgtggggcacagcc

SEQ ID NO: 11695 - DNA, 25 bp, Homo sapiens
aggcggtggctgtggggcacagcca

SEQ ID NO: 11696 - DNA, 25 bp, Homo sapiens
ggcggtggctgtggggcacagccaa

SEQ ID NO: 11697 - DNA, 25 bp, Homo sapiens
gcggtggctgtggggcacagccaag

SEQ ID NO: 11698 - DNA, 25 bp, Homo sapiens
cggtggctgtggggcacagccaagt

SEQ ID NO: 11699 - DNA, 25 bp, Homo sapiens
ggtggctgtggggcacagccaagtt

SEQ ID NO: 11700 - DNA, 25 bp, Homo sapiens
gtggctgtggggcacagccaagttt

SEQ ID NO: 11701 - DNA, 25 bp, Homo sapiens
tggctgtggggcacagccaagtttt

SEQ ID NO: 11702 - DNA, 25 bp, Homo sapiens
ggctgtggggcacagccaagttttt

SEQ ID NO: 11703 - DNA, 25 bp, Homo sapiens
gctgtggggcacagccaagtttttc

SEQ ID NO: 11704 - DNA, 25 bp, Homo sapiens
ctgtggggcacagccaagtttttct

SEQ ID NO: 11705 - DNA, 25 bp, Homo sapiens
tgtggggcacagccaagtttttctc

SEQ ID NO: 11706 - DNA, 25 bp, Homo sapiens
gtggggcacagccaagtttttctca

SEQ ID NO: 11707 - DNA, 25 bp, Homo sapiens
tggggcacagccaagtttttctcaa

SEQ ID NO: 11708 - DNA, 25 bp, Homo sapiens
ggggcacagccaagtttttctcaag

SEQ ID NO: 11709 - DNA, 25 bp, Homo sapiens
gggcacagccaagtttttctcaagg

SEQ ID NO: 11710 - DNA, 25 bp, Homo sapiens
ggcacagccaagtttttctcaaggc

SEQ ID NO: 11711 - DNA, 25 bp, Homo sapiens
gcacagccaagtttttctcaaggca

SEQ ID NO: 11712 - DNA, 25 bp, Homo sapiens
cacagccaagtttttctcaaggcag

SEQ ID NO: 11713 - DNA, 25 bp, Homo sapiens
acagccaagtttttctcaaggcagg

SEQ ID NO: 11714 - DNA, 25 bp, Homo sapiens
cagccaagtttttctcaaggcaggt

SEQ ID NO: 11715 - DNA, 25 bp, Homo sapiens
agccaagtttttctcaaggcaggtg

SEQ ID NO: 11716 - DNA, 25 bp, Homo sapiens
gccaagtttttctcaaggcaggtgt

SEQ ID NO: 11717 - DNA, 25 bp, Homo sapiens
ccaagtttttctcaaggcaggtgtg

SEQ ID NO: 11718 - DNA, 25 bp, Homo sapiens
caagtttttctcaaggcaggtgtga

SEQ ID NO: 11719 - DNA, 25 bp, Homo sapiens
aagtttttctcaaggcaggtgtgat

SEQ ID NO: 11720 - DNA, 25 bp, Homo sapiens
agtttttctcaaggcaggtgtgatc

SEQ ID NO: 11721 - DNA, 25 bp, Homo sapiens
gtttttctcaaggcaggtgtgatct

SEQ ID NO: 11722 - DNA, 25 bp, Homo sapiens
tttttctcaaggcaggtgtgatctc

SEQ ID NO: 11723 - DNA, 25 bp, Homo sapiens
ttttctcaaggcaggtgtgatctcc

SEQ ID NO: 11724 - DNA, 25 bp, Homo sapiens
tttctcaaggcaggtgtgatctcca

SEQ ID NO: 11725 - DNA, 25 bp, Homo sapiens
ttctcaaggcaggtgtgatctccag

SEQ ID NO: 11726 - DNA, 25 bp, Homo sapiens
tctcaaggcaggtgtgatctccagg

SEQ ID NO: 11727 - DNA, 25 bp, Homo sapiens
ctcaaggcaggtgtgatctccaggc

SEQ ID NO: 11728 - DNA, 25 bp, Homo sapiens
tcaaggcaggtgtgatctccaggct

SEQ ID NO: 11729 - DNA, 25 bp, Homo sapiens
caaggcaggtgtgatctccaggctt

SEQ ID NO: 11730 - DNA, 25 bp, Homo sapiens
aaggcaggtgtgatctccaggcttg

SEQ ID NO: 11731 - DNA, 25 bp, Homo sapiens
aggcaggtgtgatctccaggcttga

SEQ ID NO: 11732 - DNA, 25 bp, Homo sapiens
ggcaggtgtgatctccaggcttgag

SEQ ID NO: 11733 - DNA, 25 bp, Homo sapiens
gcaggtgtgatctccaggcttgaga

SEQ ID NO: 11734 - DNA, 25 bp, Homo sapiens
caggtgtgatctccaggcttgagaa

SEQ ID NO: 11735 - DNA, 25 bp, Homo sapiens
aggtgtgatctccaggcttgagaag

SEQ ID NO: 11736 - DNA, 25 bp, Homo sapiens
ggtgtgatctccaggcttgagaagc

SEQ ID NO: 11737 - DNA, 25 bp, Homo sapiens
gtgtgatctccaggcttgagaagca

SEQ ID NO: 11738 - DNA, 25 bp, Homo sapiens
tgtgatctccaggcttgagaagcag

SEQ ID NO: 11739 - DNA, 25 bp, Homo sapiens
gtgatctccaggcttgagaagcagc

SEQ ID NO: 11740 - DNA, 25 bp, Homo sapiens
tgatctccaggcttgagaagcagcg

SEQ ID NO: 11741 - DNA, 25 bp, Homo sapiens
gatctccaggcttgagaagcagcga

SEQ ID NO: 11742 - DNA, 25 bp, Homo sapiens
atctccaggcttgagaagcagcgag

SEQ ID NO: 11743 - DNA, 25 bp, Homo sapiens
tctccaggcttgagaagcagcgaga

SEQ ID NO: 11744 - DNA, 25 bp, Homo sapiens
ctccaggcttgagaagcagcgagag

SEQ ID NO: 11745 - DNA, 25 bp, Homo sapiens
tccaggcttgagaagcagcgagaga

SEQ ID NO: 11746 - DNA, 25 bp, Homo sapiens
ccaggcttgagaagcagcgagagaa

SEQ ID NO: 11747 - DNA, 25 bp, Homo sapiens
caggcttgagaagcagcgagagaag

SEQ ID NO: 11748 - DNA, 25 bp, Homo sapiens
aggcttgagaagcagcgagagaagc

SEQ ID NO: 11749 - DNA, 25 bp, Homo sapiens
ggcttgagaagcagcgagagaagct

SEQ ID NO: 11750 - DNA, 25 bp, Homo sapiens
gcttgagaagcagcgagagaagctg

SEQ ID NO: 11751 - DNA, 25 bp, Homo sapiens
cttgagaagcagcgagagaagctgg

SEQ ID NO: 11752 - DNA, 25 bp, Homo sapiens
ttgagaagcagcgagagaagctggt

SEQ ID NO: 11753 - DNA, 25 bp, Homo sapiens
tgagaagcagcgagagaagctggta

SEQ ID NO: 11754 - DNA, 25 bp, Homo sapiens
gagaagcagcgagagaagctggtat

SEQ ID NO: 11755 - DNA, 25 bp, Homo sapiens
agaagcagcgagagaagctggtatc

SEQ ID NO: 11756 - DNA, 25 bp, Homo sapiens
gaagcagcgagagaagctggtatct

SEQ ID NO: 11757 - DNA, 25 bp, Homo sapiens
aagcagcgagagaagctggtatctc

SEQ ID NO: 11758 - DNA, 25 bp, Homo sapiens
agcagcgagagaagctggtatctca

SEQ ID NO: 11759 - DNA, 25 bp, Homo sapiens
gcagcgagagaagctggtatctcag

SEQ ID NO: 11760 - DNA, 25 bp, Homo sapiens
cagcgagagaagctggtatctcaga

SEQ ID NO: 11761 - DNA, 25 bp, Homo sapiens
agcgagagaagctggtatctcagag

SEQ ID NO: 11762 - DNA, 25 bp, Homo sapiens
gcgagagaagctggtatctcagagc

SEQ ID NO: 11763 - DNA, 25 bp, Homo sapiens
cgagagaagctggtatctcagagca

SEQ ID NO: 11764 - DNA, 25 bp, Homo sapiens
gagagaagctggtatctcagagcat

SEQ ID NO: 11765 - DNA, 25 bp, Homo sapiens
agagaagctggtatctcagagcatc

SEQ ID NO: 11766 - DNA, 25 bp, Homo sapiens
gagaagctggtatctcagagcatcg

SEQ ID NO: 11767 - DNA, 25 bp, Homo sapiens
agaagctggtatctcagagcatcgt

SEQ ID NO: 11768 - DNA, 25 bp, Homo sapiens
gaagctggtatctcagagcatcgtt

SEQ ID NO: 11769 - DNA, 25 bp, Homo sapiens
aagctggtatctcagagcatcgttc

SEQ ID NO: 11770 - DNA, 25 bp, Homo sapiens
agctggtatctcagagcatcgttct

SEQ ID NO: 11771 - DNA, 25 bp, Homo sapiens
gctggtatctcagagcatcgttctc

SEQ ID NO: 11772 - DNA, 25 bp, Homo sapiens
ctggtatctcagagcatcgttctct

SEQ ID NO: 11773 - DNA, 25 bp, Homo sapiens
tggtatctcagagcatcgttctctt

SEQ ID NO: 11774 - DNA, 25 bp, Homo sapiens
ggtatctcagagcatcgttctcttc

SEQ ID NO: 11775 - DNA, 25 bp, Homo sapiens
gtatctcagagcatcgttctcttcc

SEQ ID NO: 11776 - DNA, 25 bp, Homo sapiens
tatctcagagcatcgttctcttcca

SEQ ID NO: 11777 - DNA, 25 bp, Homo sapiens
atctcagagcatcgttctcttccag

SEQ ID NO: 11778 - DNA, 25 bp, Homo sapiens
tctcagagcatcgttctcttccagg

SEQ ID NO: 11779 - DNA, 25 bp, Homo sapiens
ctcagagcatcgttctcttccaggc

SEQ ID NO: 11780 - DNA, 25 bp, Homo sapiens
tcagagcatcgttctcttccaggcg

SEQ ID NO: 11781 - DNA, 25 bp, Homo sapiens
cagagcatcgttctcttccaggcgg

SEQ ID NO: 11782 - DNA, 25 bp, Homo sapiens
agagcatcgttctcttccaggcggc

SEQ ID NO: 11783 - DNA, 25 bp, Homo sapiens
gagcatcgttctcttccaggcggct

SEQ ID NO: 11784 - DNA, 25 bp, Homo sapiens
agcatcgttctcttccaggcggctt

SEQ ID NO: 11785 - DNA, 25 bp, Homo sapiens
gcatcgttctcttccaggcggcttg

SEQ ID NO: 11786 - DNA, 25 bp, Homo sapiens
catcgttctcttccaggcggcttgc

SEQ ID NO: 11787 - DNA, 25 bp, Homo sapiens
atcgttctcttccaggcggcttgca

SEQ ID NO: 11788 - DNA, 25 bp, Homo sapiens
tcgttctcttccaggcggcttgcaa

SEQ ID NO: 11789 - DNA, 25 bp, Homo sapiens
cgttctcttccaggcggcttgcaag

SEQ ID NO: 11790 - DNA, 25 bp, Homo sapiens
gttctcttccaggcggcttgcaagg

SEQ ID NO: 11791 - DNA, 25 bp, Homo sapiens
ttctcttccaggcggcttgcaaggg

SEQ ID NO: 11792 - DNA, 25 bp, Homo sapiens
tctcttccaggcggcttgcaagggc

SEQ ID NO: 11793 - DNA, 25 bp, Homo sapiens
ctcttccaggcggcttgcaagggct

SEQ ID NO: 11794 - DNA, 25 bp, Homo sapiens
tcttccaggcggcttgcaagggctt

SEQ ID NO: 11795 - DNA, 25 bp, Homo sapiens
cttccaggcggcttgcaagggcttt

SEQ ID NO: 11796 - DNA, 25 bp, Homo sapiens
ttccaggcggcttgcaagggctttc

SEQ ID NO: 11797 - DNA, 25 bp, Homo sapiens
tccaggcggcttgcaagggctttct

SEQ ID NO: 11798 - DNA, 25 bp, Homo sapiens
ccaggcggcttgcaagggctttctg

SEQ ID NO: 11799 - DNA, 25 bp, Homo sapiens
caggcggcttgcaagggctttctgt

SEQ ID NO: 11800 - DNA, 25 bp, Homo sapiens
aggcggcttgcaagggctttctgtc

SEQ ID NO: 11801 - DNA, 25 bp, Homo sapiens
ggcggcttgcaagggctttctgtct

SEQ ID NO: 11802 - DNA, 25 bp, Homo sapiens
gcggcttgcaagggctttctgtctc

SEQ ID NO: 11803 - DNA, 25 bp, Homo sapiens
cggcttgcaagggctttctgtctcg

SEQ ID NO: 11804 - DNA, 25 bp, Homo sapiens
ggcttgcaagggctttctgtctcgc

SEQ ID NO: 11805 - DNA, 25 bp, Homo sapiens
gcttgcaagggctttctgtctcgcc

SEQ ID NO: 11806 - DNA, 25 bp, Homo sapiens
cttgcaagggctttctgtctcgcca

SEQ ID NO: 11807 - DNA, 25 bp, Homo sapiens
ttgcaagggctttctgtctcgccag

SEQ ID NO: 11808 - DNA, 25 bp, Homo sapiens
tgcaagggctttctgtctcgccagg

SEQ ID NO: 11809 - DNA, 25 bp, Homo sapiens
gcaagggctttctgtctcgccagga

SEQ ID NO: 11810 - DNA, 25 bp, Homo sapiens
caagggctttctgtctcgccaggaa

SEQ ID NO: 11811 - DNA, 25 bp, Homo sapiens
aagggctttctgtctcgccaggaat

SEQ ID NO: 11812 - DNA, 25 bp, Homo sapiens
agggctttctgtctcgccaggaatt

SEQ ID NO: 11813 - DNA, 25 bp, Homo sapiens
gggctttctgtctcgccaggaattc

SEQ ID NO: 11814 - DNA, 25 bp, Homo sapiens
ggctttctgtctcgccaggaattca

SEQ ID NO: 11815 - DNA, 25 bp, Homo sapiens
gctttctgtctcgccaggaattcaa

SEQ ID NO: 11816 - DNA, 25 bp, Homo sapiens
ctttctgtctcgccaggaattcaag

SEQ ID NO: 11817 - DNA, 25 bp, Homo sapiens
tttctgtctcgccaggaattcaaga

SEQ ID NO: 11818 - DNA, 25 bp, Homo sapiens
ttctgtctcgccaggaattcaagaa

SEQ ID NO: 11819 - DNA, 25 bp, Homo sapiens
tctgtctcgccaggaattcaagaag

SEQ ID NO: 11820 - DNA, 25 bp, Homo sapiens
ctgtctcgccaggaattcaagaagc

SEQ ID NO: 11821 - DNA, 25 bp, Homo sapiens
tgtctcgccaggaattcaagaagct

SEQ ID NO: 11822 - DNA, 25 bp, Homo sapiens
gtctcgccaggaattcaagaagctg

SEQ ID NO: 11823 - DNA, 25 bp, Homo sapiens
tctcgccaggaattcaagaagctga

SEQ ID NO: 11824 - DNA, 25 bp, Homo sapiens
ctcgccaggaattcaagaagctgaa

SEQ ID NO: 11825 - DNA, 25 bp, Homo sapiens
tcgccaggaattcaagaagctgaag

SEQ ID NO: 11826 - DNA, 25 bp, Homo sapiens
cgccaggaattcaagaagctgaaga

SEQ ID NO: 11827 - DNA, 25 bp, Homo sapiens
gccaggaattcaagaagctgaagat

SEQ ID NO: 11828 - DNA, 25 bp, Homo sapiens
ccaggaattcaagaagctgaagatt

SEQ ID NO: 11829 - DNA, 25 bp, Homo sapiens
caggaattcaagaagctgaagattc

SEQ ID NO: 11830 - DNA, 25 bp, Homo sapiens
aggaattcaagaagctgaagattcg

SEQ ID NO: 11831 - DNA, 25 bp, Homo sapiens
ggaattcaagaagctgaagattcgc

SEQ ID NO: 11832 - DNA, 25 bp, Homo sapiens
gaattcaagaagctgaagattcgcc

SEQ ID NO: 11833 - DNA, 25 bp, Homo sapiens
aattcaagaagctgaagattcgccg

SEQ ID NO: 11834 - DNA, 25 bp, Homo sapiens
attcaagaagctgaagattcgccga

SEQ ID NO: 11835 - DNA, 25 bp, Homo sapiens
ttcaagaagctgaagattcgccgac

SEQ ID NO: 11836 - DNA, 25 bp, Homo sapiens
tcaagaagctgaagattcgccgact

SEQ ID NO: 11837 - DNA, 25 bp, Homo sapiens
caagaagctgaagattcgccgactg

SEQ ID NO: 11838 - DNA, 25 bp, Homo sapiens
aagaagctgaagattcgccgactgg

SEQ ID NO: 11839 - DNA, 25 bp, Homo sapiens
agaagctgaagattcgccgactggc

SEQ ID NO: 11840 - DNA, 25 bp, Homo sapiens
gaagctgaagattcgccgactggct

SEQ ID NO: 11841 - DNA, 25 bp, Homo sapiens
aagctgaagattcgccgactggctg

SEQ ID NO: 11842 - DNA, 25 bp, Homo sapiens
agctgaagattcgccgactggctgc

SEQ ID NO: 11843 - DNA, 25 bp, Homo sapiens
gctgaagattcgccgactggctgca

SEQ ID NO: 11844 - DNA, 25 bp, Homo sapiens
ctgaagattcgccgactggctgcac

SEQ ID NO: 11845 - DNA, 25 bp, Homo sapiens
tgaagattcgccgactggctgcaca

SEQ ID NO: 11846 - DNA, 25 bp, Homo sapiens
gaagattcgccgactggctgcacag

SEQ ID NO: 11847 - DNA, 25 bp, Homo sapiens
aagattcgccgactggctgcacagt

SEQ ID NO: 11848 - DNA, 25 bp, Homo sapiens
agattcgccgactggctgcacagtg

SEQ ID NO: 11849 - DNA, 25 bp, Homo sapiens
gattcgccgactggctgcacagtgc

SEQ ID NO: 11850 - DNA, 25 bp, Homo sapiens
attcgccgactggctgcacagtgca

SEQ ID NO: 11851 - DNA, 25 bp, Homo sapiens
ttcgccgactggctgcacagtgcat

SEQ ID NO: 11852 - DNA, 25 bp, Homo sapiens
tcgccgactggctgcacagtgcatc

SEQ ID NO: 11853 - DNA, 25 bp, Homo sapiens
cgccgactggctgcacagtgcatcc

SEQ ID NO: 11854 - DNA, 25 bp, Homo sapiens
gccgactggctgcacagtgcatcca

SEQ ID NO: 11855 - DNA, 25 bp, Homo sapiens
ccgactggctgcacagtgcatccag

SEQ ID NO: 11856 - DNA, 25 bp, Homo sapiens
cgactggctgcacagtgcatccaga

SEQ ID NO: 11857 - DNA, 25 bp, Homo sapiens
gactggctgcacagtgcatccagaa

SEQ ID NO: 11858 - DNA, 25 bp, Homo sapiens
actggctgcacagtgcatccagaag

SEQ ID NO: 11859 - DNA, 25 bp, Homo sapiens
ctggctgcacagtgcatccagaaga

SEQ ID NO: 11860 - DNA, 25 bp, Homo sapiens
tggctgcacagtgcatccagaagaa

SEQ ID NO: 11861 - DNA, 25 bp, Homo sapiens
ggctgcacagtgcatccagaagaat

SEQ ID NO: 11862 - DNA, 25 bp, Homo sapiens
gctgcacagtgcatccagaagaatg

SEQ ID NO: 11863 - DNA, 25 bp, Homo sapiens
ctgcacagtgcatccagaagaatgt

SEQ ID NO: 11864 - DNA, 25 bp, Homo sapiens
tgcacagtgcatccagaagaatgtg

SEQ ID NO: 11865 - DNA, 25 bp, Homo sapiens
gcacagtgcatccagaagaatgtgg

SEQ ID NO: 11866 - DNA, 25 bp, Homo sapiens
cacagtgcatccagaagaatgtggc

SEQ ID NO: 11867 - DNA, 25 bp, Homo sapiens
acagtgcatccagaagaatgtggct

SEQ ID NO: 11868 - DNA, 25 bp, Homo sapiens
cagtgcatccagaagaatgtggctg

SEQ ID NO: 11869 - DNA, 25 bp, Homo sapiens
agtgcatccagaagaatgtggctgt

SEQ ID NO: 11870 - DNA, 25 bp, Homo sapiens
gtgcatccagaagaatgtggctgtg

SEQ ID NO: 11871 - DNA, 25 bp, Homo sapiens
tgcatccagaagaatgtggctgtgt

SEQ ID NO: 11872 - DNA, 25 bp, Homo sapiens
gcatccagaagaatgtggctgtgtt

SEQ ID NO: 11873 - DNA, 25 bp, Homo sapiens
catccagaagaatgtggctgtgttc

SEQ ID NO: 11874 - DNA, 25 bp, Homo sapiens
atccagaagaatgtggctgtgttcc

SEQ ID NO: 11875 - DNA, 25 bp, Homo sapiens
tccagaagaatgtggctgtgttcct

SEQ ID NO: 11876 - DNA, 25 bp, Homo sapiens
ccagaagaatgtggctgtgttcctc

SEQ ID NO: 11877 - DNA, 25 bp, Homo sapiens
cagaagaatgtggctgtgttcctcg

SEQ ID NO: 11878 - DNA, 25 bp, Homo sapiens
agaagaatgtggctgtgttcctcgc

SEQ ID NO: 11879 - DNA, 25 bp, Homo sapiens
gaagaatgtggctgtgttcctcgca

SEQ ID NO: 11880 - DNA, 25 bp, Homo sapiens
aagaatgtggctgtgttcctcgcag

SEQ ID NO: 11881 - DNA, 25 bp, Homo sapiens
agaatgtggctgtgttcctcgcagt

SEQ ID NO: 11882 - DNA, 25 bp, Homo sapiens
gaatgtggctgtgttcctcgcagtc

SEQ ID NO: 11883 - DNA, 25 bp, Homo sapiens
aatgtggctgtgttcctcgcagtca

SEQ ID NO: 11884 - DNA, 25 bp, Homo sapiens
atgtggctgtgttcctcgcagtcaa

SEQ ID NO: 11885 - DNA, 25 bp, Homo sapiens
tgtggctgtgttcctcgcagtcaag

SEQ ID NO: 11886 - DNA, 25 bp, Homo sapiens
gtggctgtgttcctcgcagtcaagg

SEQ ID NO: 11887 - DNA, 25 bp, Homo sapiens
tggctgtgttcctcgcagtcaagga

SEQ ID NO: 11888 - DNA, 25 bp, Homo sapiens
ggctgtgttcctcgcagtcaaggac

SEQ ID NO: 11889 - DNA, 25 bp, Homo sapiens
gctgtgttcctcgcagtcaaggact

SEQ ID NO: 11890 - DNA, 25 bp, Homo sapiens
ctgtgttcctcgcagtcaaggactg

SEQ ID NO: 11891 - DNA, 25 bp, Homo sapiens
tgtgttcctcgcagtcaaggactgg

SEQ ID NO: 11892 - DNA, 25 bp, Homo sapiens
gtgttcctcgcagtcaaggactggc

SEQ ID NO: 11893 - DNA, 25 bp, Homo sapiens
tgttcctcgcagtcaaggactggcc

SEQ ID NO: 11894 - DNA, 25 bp, Homo sapiens
gttcctcgcagtcaaggactggcca

SEQ ID NO: 11895 - DNA, 25 bp, Homo sapiens
ttcctcgcagtcaaggactggccat

SEQ ID NO: 11896 - DNA, 25 bp, Homo sapiens
tcctcgcagtcaaggactggccatg

SEQ ID NO: 11897 - DNA, 25 bp, Homo sapiens
cctcgcagtcaaggactggccatgg

SEQ ID NO: 11898 - DNA, 25 bp, Homo sapiens
ctcgcagtcaaggactggccatggt

SEQ ID NO: 11899 - DNA, 25 bp, Homo sapiens
tcgcagtcaaggactggccatggtg

SEQ ID NO: 11900 - DNA, 25 bp, Homo sapiens
cgcagtcaaggactggccatggtgg

SEQ ID NO: 11901 - DNA, 25 bp, Homo sapiens
gcagtcaaggactggccatggtggc

SEQ ID NO: 11902 - DNA, 25 bp, Homo sapiens
cagtcaaggactggccatggtggca

SEQ ID NO: 11903 - DNA, 25 bp, Homo sapiens
agtcaaggactggccatggtggcag

SEQ ID NO: 11904 - DNA, 25 bp, Homo sapiens
gtcaaggactggccatggtggcagc

SEQ ID NO: 11905 - DNA, 25 bp, Homo sapiens
tcaaggactggccatggtggcagct

SEQ ID NO: 11906 - DNA, 25 bp, Homo sapiens
caaggactggccatggtggcagctg

SEQ ID NO: 11907 - DNA, 25 bp, Homo sapiens
aaggactggccatggtggcagctgc

SEQ ID NO: 11908 - DNA, 25 bp, Homo sapiens
aggactggccatggtggcagctgct

SEQ ID NO: 11909 - DNA, 25 bp, Homo sapiens
ggactggccatggtggcagctgctt

SEQ ID NO: 11910 - DNA, 25 bp, Homo sapiens
gactggccatggtggcagctgcttg

SEQ ID NO: 11911 - DNA, 25 bp, Homo sapiens
actggccatggtggcagctgcttgg

SEQ ID NO: 11912 - DNA, 25 bp, Homo sapiens
ctggccatggtggcagctgcttggt

SEQ ID NO: 11913 - DNA, 25 bp, Homo sapiens
tggccatggtggcagctgcttggtt

SEQ ID NO: 11914 - DNA, 25 bp, Homo sapiens
ggccatggtggcagctgcttggttc

SEQ ID NO: 11915 - DNA, 25 bp, Homo sapiens
gccatggtggcagctgcttggttcc

SEQ ID NO: 11916 - DNA, 25 bp, Homo sapiens
ccatggtggcagctgcttggttccc

SEQ ID NO: 11917 - DNA, 25 bp, Homo sapiens
catggtggcagctgcttggttccct

SEQ ID NO: 11918 - DNA, 25 bp, Homo sapiens
atggtggcagctgcttggttccctc

SEQ ID NO: 11919 - DNA, 25 bp, Homo sapiens
tggtggcagctgcttggttccctcc

SEQ ID NO: 11920 - DNA, 25 bp, Homo sapiens
ggtggcagctgcttggttccctcca

SEQ ID NO: 11921 - DNA, 25 bp, Homo sapiens
gtggcagctgcttggttccctccag

SEQ ID NO: 11922 - DNA, 25 bp, Homo sapiens
tggcagctgcttggttccctccagc

SEQ ID NO: 11923 - DNA, 25 bp, Homo sapiens
ggcagctgcttggttccctccagcc

SEQ ID NO: 11924 - DNA, 25 bp, Homo sapiens
gcagctgcttggttccctccagcct

SEQ ID NO: 11925 - DNA, 25 bp, Homo sapiens
cagctgcttggttccctccagcctc

SEQ ID NO: 11926 - DNA, 25 bp, Homo sapiens
agctgcttggttccctccagcctct

SEQ ID NO: 11927 - DNA, 25 bp, Homo sapiens
gctgcttggttccctccagcctcta

SEQ ID NO: 11928 - DNA, 25 bp, Homo sapiens
ctgcttggttccctccagcctctac

SEQ ID NO: 11929 - DNA, 25 bp, Homo sapiens
tgcttggttccctccagcctctact

SEQ ID NO: 11930 - DNA, 25 bp, Homo sapiens
gcttggttccctccagcctctactt

SEQ ID NO: 11931 - DNA, 25 bp, Homo sapiens
cttggttccctccagcctctactta

SEQ ID NO: 11932 - DNA, 25 bp, Homo sapiens
ttggttccctccagcctctacttag

SEQ ID NO: 11933 - DNA, 25 bp, Homo sapiens
tggttccctccagcctctacttagt

SEQ ID NO: 11934 - DNA, 25 bp, Homo sapiens
ggttccctccagcctctacttagtg

SEQ ID NO: 11935 - DNA, 25 bp, Homo sapiens
gttccctccagcctctacttagtgc

SEQ ID NO: 11936 - DNA, 25 bp, Homo sapiens
ttccctccagcctctacttagtgcc

SEQ ID NO: 11937 - DNA, 25 bp, Homo sapiens
tccctccagcctctacttagtgcca

SEQ ID NO: 11938 - DNA, 25 bp, Homo sapiens
ccctccagcctctacttagtgccac

SEQ ID NO: 11939 - DNA, 25 bp, Homo sapiens
cctccagcctctacttagtgccacc

SEQ ID NO: 11940 - DNA, 25 bp, Homo sapiens
ctccagcctctacttagtgccacca

SEQ ID NO: 11941 - DNA, 25 bp, Homo sapiens
tccagcctctacttagtgccaccat

SEQ ID NO: 11942 - DNA, 25 bp, Homo sapiens
ccagcctctacttagtgccaccatt

SEQ ID NO: 11943 - DNA, 25 bp, Homo sapiens
cagcctctacttagtgccaccattg

SEQ ID NO: 11944 - DNA, 25 bp, Homo sapiens
agcctctacttagtgccaccattgg

SEQ ID NO: 11945 - DNA, 25 bp, Homo sapiens
gcctctacttagtgccaccattgga

SEQ ID NO: 11946 - DNA, 25 bp, Homo sapiens
cctctacttagtgccaccattggaa

SEQ ID NO: 11947 - DNA, 25 bp, Homo sapiens
ctctacttagtgccaccattggaac

SEQ ID NO: 11948 - DNA, 25 bp, Homo sapiens
tctacttagtgccaccattggaact

SEQ ID NO: 11949 - DNA, 25 bp, Homo sapiens
ctacttagtgccaccattggaactg

SEQ ID NO: 11950 - DNA, 25 bp, Homo sapiens
tacttagtgccaccattggaactga

SEQ ID NO: 11951 - DNA, 25 bp, Homo sapiens
acttagtgccaccattggaactgag

SEQ ID NO: 11952 - DNA, 25 bp, Homo sapiens
cttagtgccaccattggaactgagc

SEQ ID NO: 11953 - DNA, 25 bp, Homo sapiens
ttagtgccaccattggaactgagca

SEQ ID NO: 11954 - DNA, 25 bp, Homo sapiens
tagtgccaccattggaactgagcag

SEQ ID NO: 11955 - DNA, 25 bp, Homo sapiens
agtgccaccattggaactgagcagc

SEQ ID NO: 11956 - DNA, 25 bp, Homo sapiens
gtgccaccattggaactgagcagct

SEQ ID NO: 11957 - DNA, 25 bp, Homo sapiens
tgccaccattggaactgagcagctc

SEQ ID NO: 11958 - DNA, 25 bp, Homo sapiens
gccaccattggaactgagcagctcc

SEQ ID NO: 11959 - DNA, 25 bp, Homo sapiens
ccaccattggaactgagcagctccg

SEQ ID NO: 11960 - DNA, 25 bp, Homo sapiens
caccattggaactgagcagctccga

SEQ ID NO: 11961 - DNA, 25 bp, Homo sapiens
accattggaactgagcagctccgag

SEQ ID NO: 11962 - DNA, 25 bp, Homo sapiens
ccattggaactgagcagctccgagc

SEQ ID NO: 11963 - DNA, 25 bp, Homo sapiens
cattggaactgagcagctccgagcc

SEQ ID NO: 11964 - DNA, 25 bp, Homo sapiens
attggaactgagcagctccgagcca

SEQ ID NO: 11965 - DNA, 25 bp, Homo sapiens
ttggaactgagcagctccgagccaa

SEQ ID NO: 11966 - DNA, 25 bp, Homo sapiens
tggaactgagcagctccgagccaag

SEQ ID NO: 11967 - DNA, 25 bp, Homo sapiens
ggaactgagcagctccgagccaagg

SEQ ID NO: 11968 - DNA, 25 bp, Homo sapiens
gaactgagcagctccgagccaagga

SEQ ID NO: 11969 - DNA, 25 bp, Homo sapiens
aactgagcagctccgagccaaggag

SEQ ID NO: 11970 - DNA, 25 bp, Homo sapiens
actgagcagctccgagccaaggagg

SEQ ID NO: 11971 - DNA, 25 bp, Homo sapiens
ctgagcagctccgagccaaggagga

SEQ ID NO: 11972 - DNA, 25 bp, Homo sapiens
tgagcagctccgagccaaggaggag

SEQ ID NO: 11973 - DNA, 25 bp, Homo sapiens
gagcagctccgagccaaggaggagg

SEQ ID NO: 11974 - DNA, 25 bp, Homo sapiens
agcagctccgagccaaggaggagga

SEQ ID NO: 11975 - DNA, 25 bp, Homo sapiens
gcagctccgagccaaggaggaggag

SEQ ID NO: 11976 - DNA, 25 bp, Homo sapiens
cagctccgagccaaggaggaggagc

SEQ ID NO: 11977 - DNA, 25 bp, Homo sapiens
agctccgagccaaggaggaggagct

SEQ ID NO: 11978 - DNA, 25 bp, Homo sapiens
gctccgagccaaggaggaggagctt

SEQ ID NO: 11979 - DNA, 25 bp, Homo sapiens
ctccgagccaaggaggaggagctta

SEQ ID NO: 11980 - DNA, 25 bp, Homo sapiens
tccgagccaaggaggaggagcttac

SEQ ID NO: 11981 - DNA, 25 bp, Homo sapiens
ccgagccaaggaggaggagcttaca

SEQ ID NO: 11982 - DNA, 25 bp, Homo sapiens
cgagccaaggaggaggagcttacaa

SEQ ID NO: 11983 - DNA, 25 bp, Homo sapiens
gagccaaggaggaggagcttacaac

SEQ ID NO: 11984 - DNA, 25 bp, Homo sapiens
agccaaggaggaggagcttacaacg

SEQ ID NO: 11985 - DNA, 25 bp, Homo sapiens
gccaaggaggaggagcttacaacgc

SEQ ID NO: 11986 - DNA, 25 bp, Homo sapiens
ccaaggaggaggagcttacaacgct

SEQ ID NO: 11987 - DNA, 25 bp, Homo sapiens
caaggaggaggagcttacaacgcta

SEQ ID NO: 11988 - DNA, 25 bp, Homo sapiens
aaggaggaggagcttacaacgctaa

SEQ ID NO: 11989 - DNA, 25 bp, Homo sapiens
aggaggaggagcttacaacgctaag

SEQ ID NO: 11990 - DNA, 25 bp, Homo sapiens
ggaggaggagcttacaacgctaaga

SEQ ID NO: 11991 - DNA, 25 bp, Homo sapiens
gaggaggagcttacaacgctaagac

SEQ ID NO: 11992 - DNA, 25 bp, Homo sapiens
aggaggagcttacaacgctaagacg

SEQ ID NO: 11993 - DNA, 25 bp, Homo sapiens
ggaggagcttacaacgctaagacgg

SEQ ID NO: 11994 - DNA, 25 bp, Homo sapiens
gaggagcttacaacgctaagacgga

SEQ ID NO: 11995 - DNA, 25 bp, Homo sapiens
aggagcttacaacgctaagacggaa

SEQ ID NO: 11996 - DNA, 25 bp, Homo sapiens
ggagcttacaacgctaagacggaag

SEQ ID NO: 11997 - DNA, 25 bp, Homo sapiens
gagcttacaacgctaagacggaagc

SEQ ID NO: 11998 - DNA, 25 bp, Homo sapiens
agcttacaacgctaagacggaagct

SEQ ID NO: 11999 - DNA, 25 bp, Homo sapiens
gcttacaacgctaagacggaagcta

SEQ ID NO: 12000 - DNA, 25 bp, Homo sapiens
cttacaacgctaagacggaagctag

SEQ ID NO: 12001 - DNA, 25 bp, Homo sapiens
ttacaacgctaagacggaagctaga

SEQ ID NO: 12002 - DNA, 25 bp, Homo sapiens
tacaacgctaagacggaagctagaa

SEQ ID NO: 12003 - DNA, 25 bp, Homo sapiens
acaacgctaagacggaagctagaaa

SEQ ID NO: 12004 - DNA, 25 bp, Homo sapiens
caacgctaagacggaagctagaaaa

SEQ ID NO: 12005 - DNA, 25 bp, Homo sapiens
aacgctaagacggaagctagaaaaa

SEQ ID NO: 12006 - DNA, 25 bp, Homo sapiens
acgctaagacggaagctagaaaaat

SEQ ID NO: 12007 - DNA, 25 bp, Homo sapiens
cgctaagacggaagctagaaaaatc

SEQ ID NO: 12008 - DNA, 25 bp, Homo sapiens
gctaagacggaagctagaaaaatca

SEQ ID NO: 12009 - DNA, 25 bp, Homo sapiens
ctaagacggaagctagaaaaatcag

SEQ ID NO: 12010 - DNA, 25 bp, Homo sapiens
taagacggaagctagaaaaatcaga

SEQ ID NO: 12011 - DNA, 25 bp, Homo sapiens
aagacggaagctagaaaaatcagag

SEQ ID NO: 12012 - DNA, 25 bp, Homo sapiens
agacggaagctagaaaaatcagaga

SEQ ID NO: 12013 - DNA, 25 bp, Homo sapiens
gacggaagctagaaaaatcagagaa

SEQ ID NO: 12014 - DNA, 25 bp, Homo sapiens
acggaagctagaaaaatcagagaag

SEQ ID NO: 12015 - DNA, 25 bp, Homo sapiens
cggaagctagaaaaatcagagaagt

SEQ ID NO: 12016 - DNA, 25 bp, Homo sapiens
ggaagctagaaaaatcagagaagtt

SEQ ID NO: 12017 - DNA, 25 bp, Homo sapiens
gaagctagaaaaatcagagaagttg

SEQ ID NO: 12018 - DNA, 25 bp, Homo sapiens
aagctagaaaaatcagagaagttgc

SEQ ID NO: 12019 - DNA, 25 bp, Homo sapiens
agctagaaaaatcagagaagttgcg

SEQ ID NO: 12020 - DNA, 25 bp, Homo sapiens
gctagaaaaatcagagaagttgcgg

SEQ ID NO: 12021 - DNA, 25 bp, Homo sapiens
ctagaaaaatcagagaagttgcgga

SEQ ID NO: 12022 - DNA, 25 bp, Homo sapiens
tagaaaaatcagagaagttgcggaa

SEQ ID NO: 12023 - DNA, 25 bp, Homo sapiens
agaaaaatcagagaagttgcggaat

SEQ ID NO: 12024 - DNA, 25 bp, Homo sapiens
gaaaaatcagagaagttgcggaatg

SEQ ID NO: 12025 - DNA, 25 bp, Homo sapiens
aaaaatcagagaagttgcggaatga

SEQ ID NO: 12026 - DNA, 25 bp, Homo sapiens
aaaatcagagaagttgcggaatgaa

SEQ ID NO: 12027 - DNA, 25 bp, Homo sapiens
aaatcagagaagttgcggaatgaac

SEQ ID NO: 12028 - DNA, 25 bp, Homo sapiens
aatcagagaagttgcggaatgaact

SEQ ID NO: 12029 - DNA, 25 bp, Homo sapiens
atcagagaagttgcggaatgaactc

SEQ ID NO: 12030 - DNA, 25 bp, Homo sapiens
tcagagaagttgcggaatgaactcc

SEQ ID NO: 12031 - DNA, 25 bp, Homo sapiens
cagagaagttgcggaatgaactccg

SEQ ID NO: 12032 - DNA, 25 bp, Homo sapiens
agagaagttgcggaatgaactccgg

SEQ ID NO: 12033 - DNA, 25 bp, Homo sapiens
gagaagttgcggaatgaactccggc

SEQ ID NO: 12034 - DNA, 25 bp, Homo sapiens
agaagttgcggaatgaactccggca

SEQ ID NO: 12035 - DNA, 25 bp, Homo sapiens
gaagttgcggaatgaactccggcag

SEQ ID NO: 12036 - DNA, 25 bp, Homo sapiens
aagttgcggaatgaactccggcaga

SEQ ID NO: 12037 - DNA, 25 bp, Homo sapiens
agttgcggaatgaactccggcagaa

SEQ ID NO: 12038 - DNA, 25 bp, Homo sapiens
gttgcggaatgaactccggcagaac

SEQ ID NO: 12039 - DNA, 25 bp, Homo sapiens
ttgcggaatgaactccggcagaaca

SEQ ID NO: 12040 - DNA, 25 bp, Homo sapiens
tgcggaatgaactccggcagaacac

SEQ ID NO: 12041 - DNA, 25 bp, Homo sapiens
gcggaatgaactccggcagaacaca

SEQ ID NO: 12042 - DNA, 25 bp, Homo sapiens
cggaatgaactccggcagaacacag

SEQ ID NO: 12043 - DNA, 25 bp, Homo sapiens
ggaatgaactccggcagaacacaga

SEQ ID NO: 12044 - DNA, 25 bp, Homo sapiens
gaatgaactccggcagaacacagat

SEQ ID NO: 12045 - DNA, 25 bp, Homo sapiens
aatgaactccggcagaacacagatc

SEQ ID NO: 12046 - DNA, 25 bp, Homo sapiens
atgaactccggcagaacacagatct

SEQ ID NO: 12047 - DNA, 25 bp, Homo sapiens
tgaactccggcagaacacagatctg

SEQ ID NO: 12048 - DNA, 25 bp, Homo sapiens
gaactccggcagaacacagatctgc

SEQ ID NO: 12049 - DNA, 25 bp, Homo sapiens
aactccggcagaacacagatctgct

SEQ ID NO: 12050 - DNA, 25 bp, Homo sapiens
actccggcagaacacagatctgcta

SEQ ID NO: 12051 - DNA, 25 bp, Homo sapiens
ctccggcagaacacagatctgctag

SEQ ID NO: 12052 - DNA, 25 bp, Homo sapiens
tccggcagaacacagatctgctaga

SEQ ID NO: 12053 - DNA, 25 bp, Homo sapiens
ccggcagaacacagatctgctagaa

SEQ ID NO: 12054 - DNA, 25 bp, Homo sapiens
cggcagaacacagatctgctagaaa

SEQ ID NO: 12055 - DNA, 25 bp, Homo sapiens
ggcagaacacagatctgctagaaag

SEQ ID NO: 12056 - DNA, 25 bp, Homo sapiens
gcagaacacagatctgctagaaagc

SEQ ID NO: 12057 - DNA, 25 bp, Homo sapiens
cagaacacagatctgctagaaagca

SEQ ID NO: 12058 - DNA, 25 bp, Homo sapiens
agaacacagatctgctagaaagcaa

SEQ ID NO: 12059 - DNA, 25 bp, Homo sapiens
gaacacagatctgctagaaagcaag

SEQ ID NO: 12060 - DNA, 25 bp, Homo sapiens
aacacagatctgctagaaagcaaga

SEQ ID NO: 12061 - DNA, 25 bp, Homo sapiens
acacagatctgctagaaagcaagat

SEQ ID NO: 12062 - DNA, 25 bp, Homo sapiens
cacagatctgctagaaagcaagatt

SEQ ID NO: 12063 - DNA, 25 bp, Homo sapiens
acagatctgctagaaagcaagattg

SEQ ID NO: 12064 - DNA, 25 bp, Homo sapiens
cagatctgctagaaagcaagattgc

SEQ ID NO: 12065 - DNA, 25 bp, Homo sapiens
agatctgctagaaagcaagattgct

SEQ ID NO: 12066 - DNA, 25 bp, Homo sapiens
gatctgctagaaagcaagattgctg

SEQ ID NO: 12067 - DNA, 25 bp, Homo sapiens
atctgctagaaagcaagattgctga

SEQ ID NO: 12068 - DNA, 25 bp, Homo sapiens
tctgctagaaagcaagattgctgac

SEQ ID NO: 12069 - DNA, 25 bp, Homo sapiens
ctgctagaaagcaagattgctgact

SEQ ID NO: 12070 - DNA, 25 bp, Homo sapiens
tgctagaaagcaagattgctgactt

SEQ ID NO: 12071 - DNA, 25 bp, Homo sapiens
gctagaaagcaagattgctgacttg

SEQ ID NO: 12072 - DNA, 25 bp, Homo sapiens
ctagaaagcaagattgctgacttga

SEQ ID NO: 12073 - DNA, 25 bp, Homo sapiens
tagaaagcaagattgctgacttgac

SEQ ID NO: 12074 - DNA, 25 bp, Homo sapiens
agaaagcaagattgctgacttgacc

SEQ ID NO: 12075 - DNA, 25 bp, Homo sapiens
gaaagcaagattgctgacttgacct

SEQ ID NO: 12076 - DNA, 25 bp, Homo sapiens
aaagcaagattgctgacttgacctc

SEQ ID NO: 12077 - DNA, 25 bp, Homo sapiens
aagcaagattgctgacttgacctct

SEQ ID NO: 12078 - DNA, 25 bp, Homo sapiens
agcaagattgctgacttgacctctg

SEQ ID NO: 12079 - DNA, 25 bp, Homo sapiens
gcaagattgctgacttgacctctga

SEQ ID NO: 12080 - DNA, 25 bp, Homo sapiens
caagattgctgacttgacctctgac

SEQ ID NO: 12081 - DNA, 25 bp, Homo sapiens
aagattgctgacttgacctctgacc

SEQ ID NO: 12082 - DNA, 25 bp, Homo sapiens
agattgctgacttgacctctgacct

SEQ ID NO: 12083 - DNA, 25 bp, Homo sapiens
gattgctgacttgacctctgacctt

SEQ ID NO: 12084 - DNA, 25 bp, Homo sapiens
attgctgacttgacctctgaccttg

SEQ ID NO: 12085 - DNA, 25 bp, Homo sapiens
ttgctgacttgacctctgaccttgc

SEQ ID NO: 12086 - DNA, 25 bp, Homo sapiens
tgctgacttgacctctgaccttgcc

SEQ ID NO: 12087 - DNA, 25 bp, Homo sapiens
gctgacttgacctctgaccttgccg

SEQ ID NO: 12088 - DNA, 25 bp, Homo sapiens
ctgacttgacctctgaccttgccga

SEQ ID NO: 12089 - DNA, 25 bp, Homo sapiens
tgacttgacctctgaccttgccgat

SEQ ID NO: 12090 - DNA, 25 bp, Homo sapiens
gacttgacctctgaccttgccgatg

SEQ ID NO: 12091 - DNA, 25 bp, Homo sapiens
acttgacctctgaccttgccgatga

SEQ ID NO: 12092 - DNA, 25 bp, Homo sapiens
cttgacctctgaccttgccgatgag

SEQ ID NO: 12093 - DNA, 25 bp, Homo sapiens
ttgacctctgaccttgccgatgagc

SEQ ID NO: 12094 - DNA, 25 bp, Homo sapiens
tgacctctgaccttgccgatgagcg

SEQ ID NO: 12095 - DNA, 25 bp, Homo sapiens
gacctctgaccttgccgatgagcgc

SEQ ID NO: 12096 - DNA, 25 bp, Homo sapiens
acctctgaccttgccgatgagcgct

SEQ ID NO: 12097 - DNA, 25 bp, Homo sapiens
cctctgaccttgccgatgagcgctt

SEQ ID NO: 12098 - DNA, 25 bp, Homo sapiens
ctctgaccttgccgatgagcgcttc

SEQ ID NO: 12099 - DNA, 25 bp, Homo sapiens
tctgaccttgccgatgagcgcttca

SEQ ID NO: 12100 - DNA, 25 bp, Homo sapiens
ctgaccttgccgatgagcgcttcaa

SEQ ID NO: 12101 - DNA, 25 bp, Homo sapiens
tgaccttgccgatgagcgcttcaaa

SEQ ID NO: 12102 - DNA, 25 bp, Homo sapiens
gaccttgccgatgagcgcttcaaag

SEQ ID NO: 12103 - DNA, 25 bp, Homo sapiens
accttgccgatgagcgcttcaaagg

SEQ ID NO: 12104 - DNA, 25 bp, Homo sapiens
ccttgccgatgagcgcttcaaaggt

SEQ ID NO: 12105 - DNA, 25 bp, Homo sapiens
cttgccgatgagcgcttcaaaggtg

SEQ ID NO: 12106 - DNA, 25 bp, Homo sapiens
ttgccgatgagcgcttcaaaggtga

SEQ ID NO: 12107 - DNA, 25 bp, Homo sapiens
tgccgatgagcgcttcaaaggtgat

SEQ ID NO: 12108 - DNA, 25 bp, Homo sapiens
gccgatgagcgcttcaaaggtgatg

SEQ ID NO: 12109 - DNA, 25 bp, Homo sapiens
ccgatgagcgcttcaaaggtgatgt

SEQ ID NO: 12110 - DNA, 25 bp, Homo sapiens
cgatgagcgcttcaaaggtgatgtg

SEQ ID NO: 12111 - DNA, 25 bp, Homo sapiens
gatgagcgcttcaaaggtgatgtgg

SEQ ID NO: 12112 - DNA, 25 bp, Homo sapiens
atgagcgcttcaaaggtgatgtggc

SEQ ID NO: 12113 - DNA, 25 bp, Homo sapiens
tgagcgcttcaaaggtgatgtggcc

SEQ ID NO: 12114 - DNA, 25 bp, Homo sapiens
gagcgcttcaaaggtgatgtggcct

SEQ ID NO: 12115 - DNA, 25 bp, Homo sapiens
agcgcttcaaaggtgatgtggcctg

SEQ ID NO: 12116 - DNA, 25 bp, Homo sapiens
gcgcttcaaaggtgatgtggcctgc

SEQ ID NO: 12117 - DNA, 25 bp, Homo sapiens
cgcttcaaaggtgatgtggcctgcc

SEQ ID NO: 12118 - DNA, 25 bp, Homo sapiens
gcttcaaaggtgatgtggcctgcca

SEQ ID NO: 12119 - DNA, 25 bp, Homo sapiens
cttcaaaggtgatgtggcctgccag

SEQ ID NO: 12120 - DNA, 25 bp, Homo sapiens
ttcaaaggtgatgtggcctgccagg

SEQ ID NO: 12121 - DNA, 25 bp, Homo sapiens
tcaaaggtgatgtggcctgccaggt

SEQ ID NO: 12122 - DNA, 25 bp, Homo sapiens
caaaggtgatgtggcctgccaggtg

SEQ ID NO: 12123 - DNA, 25 bp, Homo sapiens
aaaggtgatgtggcctgccaggtgc

SEQ ID NO: 12124 - DNA, 25 bp, Homo sapiens
aaggtgatgtggcctgccaggtgct

SEQ ID NO: 12125 - DNA, 25 bp, Homo sapiens
aggtgatgtggcctgccaggtgctg

SEQ ID NO: 12126 - DNA, 25 bp, Homo sapiens
ggtgatgtggcctgccaggtgctgg

SEQ ID NO: 12127 - DNA, 25 bp, Homo sapiens
gtgatgtggcctgccaggtgctgga

SEQ ID NO: 12128 - DNA, 25 bp, Homo sapiens
tgatgtggcctgccaggtgctggag

SEQ ID NO: 12129 - DNA, 25 bp, Homo sapiens
gatgtggcctgccaggtgctggaga

SEQ ID NO: 12130 - DNA, 25 bp, Homo sapiens
atgtggcctgccaggtgctggagag

SEQ ID NO: 12131 - DNA, 25 bp, Homo sapiens
tgtggcctgccaggtgctggagagt

SEQ ID NO: 12132 - DNA, 25 bp, Homo sapiens
gtggcctgccaggtgctggagagtg

SEQ ID NO: 12133 - DNA, 25 bp, Homo sapiens
tggcctgccaggtgctggagagtga

SEQ ID NO: 12134 - DNA, 25 bp, Homo sapiens
ggcctgccaggtgctggagagtgag

SEQ ID NO: 12135 - DNA, 25 bp, Homo sapiens
gcctgccaggtgctggagagtgagc

SEQ ID NO: 12136 - DNA, 25 bp, Homo sapiens
cctgccaggtgctggagagtgagcg

SEQ ID NO: 12137 - DNA, 25 bp, Homo sapiens
ctgccaggtgctggagagtgagcgg

SEQ ID NO: 12138 - DNA, 25 bp, Homo sapiens
tgccaggtgctggagagtgagcggg

SEQ ID NO: 12139 - DNA, 25 bp, Homo sapiens
gccaggtgctggagagtgagcgggc

SEQ ID NO: 12140 - DNA, 25 bp, Homo sapiens
ccaggtgctggagagtgagcgggca

SEQ ID NO: 12141 - DNA, 25 bp, Homo sapiens
caggtgctggagagtgagcgggcag

SEQ ID NO: 12142 - DNA, 25 bp, Homo sapiens
aggtgctggagagtgagcgggcaga

SEQ ID NO: 12143 - DNA, 25 bp, Homo sapiens
ggtgctggagagtgagcgggcagag

SEQ ID NO: 12144 - DNA, 25 bp, Homo sapiens
gtgctggagagtgagcgggcagagc

SEQ ID NO: 12145 - DNA, 25 bp, Homo sapiens
tgctggagagtgagcgggcagagcg

SEQ ID NO: 12146 - DNA, 25 bp, Homo sapiens
gctggagagtgagcgggcagagcgg

SEQ ID NO: 12147 - DNA, 25 bp, Homo sapiens
ctggagagtgagcgggcagagcggc

SEQ ID NO: 12148 - DNA, 25 bp, Homo sapiens
tggagagtgagcgggcagagcggct

SEQ ID NO: 12149 - DNA, 25 bp, Homo sapiens
ggagagtgagcgggcagagcggcta

SEQ ID NO: 12150 - DNA, 25 bp, Homo sapiens
gagagtgagcgggcagagcggctac

SEQ ID NO: 12151 - DNA, 25 bp, Homo sapiens
agagtgagcgggcagagcggctaca

SEQ ID NO: 12152 - DNA, 25 bp, Homo sapiens
gagtgagcgggcagagcggctacag

SEQ ID NO: 12153 - DNA, 25 bp, Homo sapiens
agtgagcgggcagagcggctacagg

SEQ ID NO: 12154 - DNA, 25 bp, Homo sapiens
gtgagcgggcagagcggctacaggc

SEQ ID NO: 12155 - DNA, 25 bp, Homo sapiens
tgagcgggcagagcggctacaggcc

SEQ ID NO: 12156 - DNA, 25 bp, Homo sapiens
gagcgggcagagcggctacaggcct

SEQ ID NO: 12157 - DNA, 25 bp, Homo sapiens
agcgggcagagcggctacaggcctt

SEQ ID NO: 12158 - DNA, 25 bp, Homo sapiens
gcgggcagagcggctacaggccttc

SEQ ID NO: 12159 - DNA, 25 bp, Homo sapiens
cgggcagagcggctacaggccttcc

SEQ ID NO: 12160 - DNA, 25 bp, Homo sapiens
gggcagagcggctacaggccttccg

SEQ ID NO: 12161 - DNA, 25 bp, Homo sapiens
ggcagagcggctacaggccttccgg

SEQ ID NO: 12162 - DNA, 25 bp, Homo sapiens
gcagagcggctacaggccttccggg

SEQ ID NO: 12163 - DNA, 25 bp, Homo sapiens
cagagcggctacaggccttccggga

SEQ ID NO: 12164 - DNA, 25 bp, Homo sapiens
agagcggctacaggccttccgggag

SEQ ID NO: 12165 - DNA, 25 bp, Homo sapiens
gagcggctacaggccttccgggagg

SEQ ID NO: 12166 - DNA, 25 bp, Homo sapiens
agcggctacaggccttccgggaggt

SEQ ID NO: 12167 - DNA, 25 bp, Homo sapiens
gcggctacaggccttccgggaggtc

SEQ ID NO: 12168 - DNA, 25 bp, Homo sapiens
cggctacaggccttccgggaggtcc

SEQ ID NO: 12169 - DNA, 25 bp, Homo sapiens
ggctacaggccttccgggaggtcca

SEQ ID NO: 12170 - DNA, 25 bp, Homo sapiens
gctacaggccttccgggaggtccag

SEQ ID NO: 12171 - DNA, 25 bp, Homo sapiens
ctacaggccttccgggaggtccagg

SEQ ID NO: 12172 - DNA, 25 bp, Homo sapiens
tacaggccttccgggaggtccagga

SEQ ID NO: 12173 - DNA, 25 bp, Homo sapiens
acaggccttccgggaggtccaggag

SEQ ID NO: 12174 - DNA, 25 bp, Homo sapiens
caggccttccgggaggtccaggagc

SEQ ID NO: 12175 - DNA, 25 bp, Homo sapiens
aggccttccgggaggtccaggagct

SEQ ID NO: 12176 - DNA, 25 bp, Homo sapiens
ggccttccgggaggtccaggagctc

SEQ ID NO: 12177 - DNA, 25 bp, Homo sapiens
gccttccgggaggtccaggagctca

SEQ ID NO: 12178 - DNA, 25 bp, Homo sapiens
ccttccgggaggtccaggagctcaa

SEQ ID NO: 12179 - DNA, 25 bp, Homo sapiens
cttccgggaggtccaggagctcaag

SEQ ID NO: 12180 - DNA, 25 bp, Homo sapiens
ttccgggaggtccaggagctcaaga

SEQ ID NO: 12181 - DNA, 25 bp, Homo sapiens
tccgggaggtccaggagctcaagag

SEQ ID NO: 12182 - DNA, 25 bp, Homo sapiens
ccgggaggtccaggagctcaagagc

SEQ ID NO: 12183 - DNA, 25 bp, Homo sapiens
cgggaggtccaggagctcaagagca

SEQ ID NO: 12184 - DNA, 25 bp, Homo sapiens
gggaggtccaggagctcaagagcaa

SEQ ID NO: 12185 - DNA, 25 bp, Homo sapiens
ggaggtccaggagctcaagagcaag

SEQ ID NO: 12186 - DNA, 25 bp, Homo sapiens
gaggtccaggagctcaagagcaagc

SEQ ID NO: 12187 - DNA, 25 bp, Homo sapiens
aggtccaggagctcaagagcaagca

SEQ ID NO: 12188 - DNA, 25 bp, Homo sapiens
ggtccaggagctcaagagcaagcat

SEQ ID NO: 12189 - DNA, 25 bp, Homo sapiens
gtccaggagctcaagagcaagcatg

SEQ ID NO: 12190 - DNA, 25 bp, Homo sapiens
tccaggagctcaagagcaagcatga

SEQ ID NO: 12191 - DNA, 25 bp, Homo sapiens
ccaggagctcaagagcaagcatgaa

SEQ ID NO: 12192 - DNA, 25 bp, Homo sapiens
caggagctcaagagcaagcatgaac

SEQ ID NO: 12193 - DNA, 25 bp, Homo sapiens
aggagctcaagagcaagcatgaaca

SEQ ID NO: 12194 - DNA, 25 bp, Homo sapiens
ggagctcaagagcaagcatgaacaa

SEQ ID NO: 12195 - DNA, 25 bp, Homo sapiens
gagctcaagagcaagcatgaacaag

SEQ ID NO: 12196 - DNA, 25 bp, Homo sapiens
agctcaagagcaagcatgaacaagt

SEQ ID NO: 12197 - DNA, 25 bp, Homo sapiens
gctcaagagcaagcatgaacaagtc

SEQ ID NO: 12198 - DNA, 25 bp, Homo sapiens
ctcaagagcaagcatgaacaagtcc

SEQ ID NO: 12199 - DNA, 25 bp, Homo sapiens
tcaagagcaagcatgaacaagtcca

SEQ ID NO: 12200 - DNA, 25 bp, Homo sapiens
caagagcaagcatgaacaagtccag

SEQ ID NO: 12201 - DNA, 25 bp, Homo sapiens
aagagcaagcatgaacaagtccaga

SEQ ID NO: 12202 - DNA, 25 bp, Homo sapiens
agagcaagcatgaacaagtccagaa

SEQ ID NO: 12203 - DNA, 25 bp, Homo sapiens
gagcaagcatgaacaagtccagaaa

SEQ ID NO: 12204 - DNA, 25 bp, Homo sapiens
agcaagcatgaacaagtccagaaaa

SEQ ID NO: 12205 - DNA, 25 bp, Homo sapiens
gcaagcatgaacaagtccagaaaaa

SEQ ID NO: 12206 - DNA, 25 bp, Homo sapiens
caagcatgaacaagtccagaaaaaa

SEQ ID NO: 12207 - DNA, 25 bp, Homo sapiens
aagcatgaacaagtccagaaaaaac

SEQ ID NO: 12208 - DNA, 25 bp, Homo sapiens
agcatgaacaagtccagaaaaaact

SEQ ID NO: 12209 - DNA, 25 bp, Homo sapiens
gcatgaacaagtccagaaaaaactg

SEQ ID NO: 12210 - DNA, 25 bp, Homo sapiens
catgaacaagtccagaaaaaactgg

SEQ ID NO: 12211 - DNA, 25 bp, Homo sapiens
atgaacaagtccagaaaaaactggg

SEQ ID NO: 12212 - DNA, 25 bp, Homo sapiens
tgaacaagtccagaaaaaactggga

SEQ ID NO: 12213 - DNA, 25 bp, Homo sapiens
gaacaagtccagaaaaaactgggag

SEQ ID NO: 12214 - DNA, 25 bp, Homo sapiens
aacaagtccagaaaaaactgggaga

SEQ ID NO: 12215 - DNA, 25 bp, Homo sapiens
acaagtccagaaaaaactgggagat

SEQ ID NO: 12216 - DNA, 25 bp, Homo sapiens
caagtccagaaaaaactgggagatg

SEQ ID NO: 12217 - DNA, 25 bp, Homo sapiens
aagtccagaaaaaactgggagatgt

SEQ ID NO: 12218 - DNA, 25 bp, Homo sapiens
agtccagaaaaaactgggagatgtg

SEQ ID NO: 12219 - DNA, 25 bp, Homo sapiens
gtccagaaaaaactgggagatgtga

SEQ ID NO: 12220 - DNA, 25 bp, Homo sapiens
tccagaaaaaactgggagatgtgaa

SEQ ID NO: 12221 - DNA, 25 bp, Homo sapiens
ccagaaaaaactgggagatgtgaat

SEQ ID NO: 12222 - DNA, 25 bp, Homo sapiens
cagaaaaaactgggagatgtgaata

SEQ ID NO: 12223 - DNA, 25 bp, Homo sapiens
agaaaaaactgggagatgtgaataa

SEQ ID NO: 12224 - DNA, 25 bp, Homo sapiens
gaaaaaactgggagatgtgaataaa

SEQ ID NO: 12225 - DNA, 25 bp, Homo sapiens
aaaaaactgggagatgtgaataaac

SEQ ID NO: 12226 - DNA, 25 bp, Homo sapiens
aaaaactgggagatgtgaataaaca

SEQ ID NO: 12227 - DNA, 25 bp, Homo sapiens
aaaactgggagatgtgaataaacag

SEQ ID NO: 12228 - DNA, 25 bp, Homo sapiens
aaactgggagatgtgaataaacagt

SEQ ID NO: 12229 - DNA, 25 bp, Homo sapiens
aactgggagatgtgaataaacagtt

SEQ ID NO: 12230 - DNA, 25 bp, Homo sapiens
actgggagatgtgaataaacagttg

SEQ ID NO: 12231 - DNA, 25 bp, Homo sapiens
ctgggagatgtgaataaacagttgg

SEQ ID NO: 12232 - DNA, 25 bp, Homo sapiens
tgggagatgtgaataaacagttgga

SEQ ID NO: 12233 - DNA, 25 bp, Homo sapiens
gggagatgtgaataaacagttggaa

SEQ ID NO: 12234 - DNA, 25 bp, Homo sapiens
ggagatgtgaataaacagttggaag

SEQ ID NO: 12235 - DNA, 25 bp, Homo sapiens
gagatgtgaataaacagttggaaga

SEQ ID NO: 12236 - DNA, 25 bp, Homo sapiens
agatgtgaataaacagttggaagaa

SEQ ID NO: 12237 - DNA, 25 bp, Homo sapiens
gatgtgaataaacagttggaagaag

SEQ ID NO: 12238 - DNA, 25 bp, Homo sapiens
atgtgaataaacagttggaagaagc

SEQ ID NO: 12239 - DNA, 25 bp, Homo sapiens
tgtgaataaacagttggaagaagcc

SEQ ID NO: 12240 - DNA, 25 bp, Homo sapiens
gtgaataaacagttggaagaagccc

SEQ ID NO: 12241 - DNA, 25 bp, Homo sapiens
tgaataaacagttggaagaagccca

SEQ ID NO: 12242 - DNA, 25 bp, Homo sapiens
gaataaacagttggaagaagcccag

SEQ ID NO: 12243 - DNA, 25 bp, Homo sapiens
aataaacagttggaagaagcccagc

SEQ ID NO: 12244 - DNA, 25 bp, Homo sapiens
ataaacagttggaagaagcccagca

SEQ ID NO: 12245 - DNA, 25 bp, Homo sapiens
taaacagttggaagaagcccagcag

SEQ ID NO: 12246 - DNA, 25 bp, Homo sapiens
aaacagttggaagaagcccagcaga

SEQ ID NO: 12247 - DNA, 25 bp, Homo sapiens
aacagttggaagaagcccagcagaa

SEQ ID NO: 12248 - DNA, 25 bp, Homo sapiens
acagttggaagaagcccagcagaaa

SEQ ID NO: 12249 - DNA, 25 bp, Homo sapiens
cagttggaagaagcccagcagaaaa

SEQ ID NO: 12250 - DNA, 25 bp, Homo sapiens
agttggaagaagcccagcagaaaat

SEQ ID NO: 12251 - DNA, 25 bp, Homo sapiens
gttggaagaagcccagcagaaaatt

SEQ ID NO: 12252 - DNA, 25 bp, Homo sapiens
ttggaagaagcccagcagaaaattc

SEQ ID NO: 12253 - DNA, 25 bp, Homo sapiens
tggaagaagcccagcagaaaattca

SEQ ID NO: 12254 - DNA, 25 bp, Homo sapiens
ggaagaagcccagcagaaaattcag

SEQ ID NO: 12255 - DNA, 25 bp, Homo sapiens
gaagaagcccagcagaaaattcagt

SEQ ID NO: 12256 - DNA, 25 bp, Homo sapiens
aagaagcccagcagaaaattcagtt

SEQ ID NO: 12257 - DNA, 25 bp, Homo sapiens
agaagcccagcagaaaattcagttg

SEQ ID NO: 12258 - DNA, 25 bp, Homo sapiens
gaagcccagcagaaaattcagttga

SEQ ID NO: 12259 - DNA, 25 bp, Homo sapiens
aagcccagcagaaaattcagttgaa

SEQ ID NO: 12260 - DNA, 25 bp, Homo sapiens
agcccagcagaaaattcagttgaat

SEQ ID NO: 12261 - DNA, 25 bp, Homo sapiens
gcccagcagaaaattcagttgaatg

SEQ ID NO: 12262 - DNA, 25 bp, Homo sapiens
cccagcagaaaattcagttgaatga

SEQ ID NO: 12263 - DNA, 25 bp, Homo sapiens
ccagcagaaaattcagttgaatgac

SEQ ID NO: 12264 - DNA, 25 bp, Homo sapiens
cagcagaaaattcagttgaatgact

SEQ ID NO: 12265 - DNA, 25 bp, Homo sapiens
agcagaaaattcagttgaatgactt

SEQ ID NO: 12266 - DNA, 25 bp, Homo sapiens
gcagaaaattcagttgaatgacttg

SEQ ID NO: 12267 - DNA, 25 bp, Homo sapiens
cagaaaattcagttgaatgacttgg

SEQ ID NO: 12268 - DNA, 25 bp, Homo sapiens
agaaaattcagttgaatgacttgga

SEQ ID NO: 12269 - DNA, 25 bp, Homo sapiens
gaaaattcagttgaatgacttggaa

SEQ ID NO: 12270 - DNA, 25 bp, Homo sapiens
aaaattcagttgaatgacttggaaa

SEQ ID NO: 12271 - DNA, 25 bp, Homo sapiens
aaattcagttgaatgacttggaaag

SEQ ID NO: 12272 - DNA, 25 bp, Homo sapiens
aattcagttgaatgacttggaaagg

SEQ ID NO: 12273 - DNA, 25 bp, Homo sapiens
attcagttgaatgacttggaaaggg

SEQ ID NO: 12274 - DNA, 25 bp, Homo sapiens
ttcagttgaatgacttggaaaggga

SEQ ID NO: 12275 - DNA, 25 bp, Homo sapiens
tcagttgaatgacttggaaagggat

SEQ ID NO: 12276 - DNA, 25 bp, Homo sapiens
cagttgaatgacttggaaagggatc

SEQ ID NO: 12277 - DNA, 25 bp, Homo sapiens
agttgaatgacttggaaagggatcc

SEQ ID NO: 12278 - DNA, 25 bp, Homo sapiens
gttgaatgacttggaaagggatccc

SEQ ID NO: 12279 - DNA, 25 bp, Homo sapiens
ttgaatgacttggaaagggatccca

SEQ ID NO: 12280 - DNA, 25 bp, Homo sapiens
tgaatgacttggaaagggatcccac

SEQ ID NO: 12281 - DNA, 25 bp, Homo sapiens
gaatgacttggaaagggatcccact

SEQ ID NO: 12282 - DNA, 25 bp, Homo sapiens
aatgacttggaaagggatcccactg

SEQ ID NO: 12283 - DNA, 25 bp, Homo sapiens
atgacttggaaagggatcccactgg

SEQ ID NO: 12284 - DNA, 25 bp, Homo sapiens
tgacttggaaagggatcccactgga

SEQ ID NO: 12285 - DNA, 25 bp, Homo sapiens
gacttggaaagggatcccactggag

SEQ ID NO: 12286 - DNA, 25 bp, Homo sapiens
acttggaaagggatcccactggagg

SEQ ID NO: 12287 - DNA, 25 bp, Homo sapiens
cttggaaagggatcccactggagga

SEQ ID NO: 12288 - DNA, 25 bp, Homo sapiens
ttggaaagggatcccactggaggag

SEQ ID NO: 12289 - DNA, 25 bp, Homo sapiens
tggaaagggatcccactggaggagc

SEQ ID NO: 12290 - DNA, 25 bp, Homo sapiens
ggaaagggatcccactggaggagca

SEQ ID NO: 12291 - DNA, 25 bp, Homo sapiens
gaaagggatcccactggaggagcag

SEQ ID NO: 12292 - DNA, 25 bp, Homo sapiens
aaagggatcccactggaggagcaga

SEQ ID NO: 12293 - DNA, 25 bp, Homo sapiens
aagggatcccactggaggagcagac

SEQ ID NO: 12294 - DNA, 25 bp, Homo sapiens
agggatcccactggaggagcagacg

SEQ ID NO: 12295 - DNA, 25 bp, Homo sapiens
gggatcccactggaggagcagacga

SEQ ID NO: 12296 - DNA, 25 bp, Homo sapiens
ggatcccactggaggagcagacgag

SEQ ID NO: 12297 - DNA, 25 bp, Homo sapiens
gatcccactggaggagcagacgagt

SEQ ID NO: 12298 - DNA, 25 bp, Homo sapiens
atcccactggaggagcagacgagtg

SEQ ID NO: 12299 - DNA, 25 bp, Homo sapiens
tcccactggaggagcagacgagtgg

SEQ ID NO: 12300 - DNA, 25 bp, Homo sapiens
cccactggaggagcagacgagtggc

SEQ ID NO: 12301 - DNA, 25 bp, Homo sapiens
ccactggaggagcagacgagtggca

SEQ ID NO: 12302 - DNA, 25 bp, Homo sapiens
cactggaggagcagacgagtggcag

SEQ ID NO: 12303 - DNA, 25 bp, Homo sapiens
actggaggagcagacgagtggcaga

SEQ ID NO: 12304 - DNA, 25 bp, Homo sapiens
ctggaggagcagacgagtggcagat

SEQ ID NO: 12305 - DNA, 25 bp, Homo sapiens
tggaggagcagacgagtggcagatg

SEQ ID NO: 12306 - DNA, 25 bp, Homo sapiens
ggaggagcagacgagtggcagatgc

SEQ ID NO: 12307 - DNA, 25 bp, Homo sapiens
gaggagcagacgagtggcagatgcg

SEQ ID NO: 12308 - DNA, 25 bp, Homo sapiens
aggagcagacgagtggcagatgcgc

SEQ ID NO: 12309 - DNA, 25 bp, Homo sapiens
ggagcagacgagtggcagatgcgct

SEQ ID NO: 12310 - DNA, 25 bp, Homo sapiens
gagcagacgagtggcagatgcgctt

SEQ ID NO: 12311 - DNA, 25 bp, Homo sapiens
agcagacgagtggcagatgcgcttc

SEQ ID NO: 12312 - DNA, 25 bp, Homo sapiens
gcagacgagtggcagatgcgcttcg

SEQ ID NO: 12313 - DNA, 25 bp, Homo sapiens
cagacgagtggcagatgcgcttcga

SEQ ID NO: 12314 - DNA, 25 bp, Homo sapiens
agacgagtggcagatgcgcttcgac

SEQ ID NO: 12315 - DNA, 25 bp, Homo sapiens
gacgagtggcagatgcgcttcgact

SEQ ID NO: 12316 - DNA, 25 bp, Homo sapiens
acgagtggcagatgcgcttcgactg

SEQ ID NO: 12317 - DNA, 25 bp, Homo sapiens
cgagtggcagatgcgcttcgactgt

SEQ ID NO: 12318 - DNA, 25 bp, Homo sapiens
gagtggcagatgcgcttcgactgtg

SEQ ID NO: 12319 - DNA, 25 bp, Homo sapiens
agtggcagatgcgcttcgactgtgc

SEQ ID NO: 12320 - DNA, 25 bp, Homo sapiens
gtggcagatgcgcttcgactgtgct

SEQ ID NO: 12321 - DNA, 25 bp, Homo sapiens
tggcagatgcgcttcgactgtgctc

SEQ ID NO: 12322 - DNA, 25 bp, Homo sapiens
ggcagatgcgcttcgactgtgctca

SEQ ID NO: 12323 - DNA, 25 bp, Homo sapiens
gcagatgcgcttcgactgtgctcag

SEQ ID NO: 12324 - DNA, 25 bp, Homo sapiens
cagatgcgcttcgactgtgctcaga

SEQ ID NO: 12325 - DNA, 25 bp, Homo sapiens
agatgcgcttcgactgtgctcagat

SEQ ID NO: 12326 - DNA, 25 bp, Homo sapiens
gatgcgcttcgactgtgctcagatg

SEQ ID NO: 12327 - DNA, 25 bp, Homo sapiens
atgcgcttcgactgtgctcagatgg

SEQ ID NO: 12328 - DNA, 25 bp, Homo sapiens
tgcgcttcgactgtgctcagatgga

SEQ ID NO: 12329 - DNA, 25 bp, Homo sapiens
gcgcttcgactgtgctcagatggag

SEQ ID NO: 12330 - DNA, 25 bp, Homo sapiens
cgcttcgactgtgctcagatggaga

SEQ ID NO: 12331 - DNA, 25 bp, Homo sapiens
gcttcgactgtgctcagatggagaa

SEQ ID NO: 12332 - DNA, 25 bp, Homo sapiens
cttcgactgtgctcagatggagaac

SEQ ID NO: 12333 - DNA, 25 bp, Homo sapiens
ttcgactgtgctcagatggagaacg

SEQ ID NO: 12334 - DNA, 25 bp, Homo sapiens
tcgactgtgctcagatggagaacga

SEQ ID NO: 12335 - DNA, 25 bp, Homo sapiens
cgactgtgctcagatggagaacgag

SEQ ID NO: 12336 - DNA, 25 bp, Homo sapiens
gactgtgctcagatggagaacgagt

SEQ ID NO: 12337 - DNA, 25 bp, Homo sapiens
actgtgctcagatggagaacgagtt

SEQ ID NO: 12338 - DNA, 25 bp, Homo sapiens
ctgtgctcagatggagaacgagttc

SEQ ID NO: 12339 - DNA, 25 bp, Homo sapiens
tgtgctcagatggagaacgagttcc

SEQ ID NO: 12340 - DNA, 25 bp, Homo sapiens
gtgctcagatggagaacgagttcct

SEQ ID NO: 12341 - DNA, 25 bp, Homo sapiens
tgctcagatggagaacgagttcctc

SEQ ID NO: 12342 - DNA, 25 bp, Homo sapiens
gctcagatggagaacgagttcctca

SEQ ID NO: 12343 - DNA, 25 bp, Homo sapiens
ctcagatggagaacgagttcctcag

SEQ ID NO: 12344 - DNA, 25 bp, Homo sapiens
tcagatggagaacgagttcctcaga

SEQ ID NO: 12345 - DNA, 25 bp, Homo sapiens
cagatggagaacgagttcctcagaa

SEQ ID NO: 12346 - DNA, 25 bp, Homo sapiens
agatggagaacgagttcctcagaaa

SEQ ID NO: 12347 - DNA, 25 bp, Homo sapiens
gatggagaacgagttcctcagaaag

SEQ ID NO: 12348 - DNA, 25 bp, Homo sapiens
atggagaacgagttcctcagaaagc

SEQ ID NO: 12349 - DNA, 25 bp, Homo sapiens
tggagaacgagttcctcagaaagcg

SEQ ID NO: 12350 - DNA, 25 bp, Homo sapiens
ggagaacgagttcctcagaaagcgt

SEQ ID NO: 12351 - DNA, 25 bp, Homo sapiens
gagaacgagttcctcagaaagcgtc

SEQ ID NO: 12352 - DNA, 25 bp, Homo sapiens
agaacgagttcctcagaaagcgtct

SEQ ID NO: 12353 - DNA, 25 bp, Homo sapiens
gaacgagttcctcagaaagcgtctg

SEQ ID NO: 12354 - DNA, 25 bp, Homo sapiens
aacgagttcctcagaaagcgtctgc

SEQ ID NO: 12355 - DNA, 25 bp, Homo sapiens
acgagttcctcagaaagcgtctgca

SEQ ID NO: 12356 - DNA, 25 bp, Homo sapiens
cgagttcctcagaaagcgtctgcag

SEQ ID NO: 12357 - DNA, 25 bp, Homo sapiens
gagttcctcagaaagcgtctgcagc

SEQ ID NO: 12358 - DNA, 25 bp, Homo sapiens
agttcctcagaaagcgtctgcagca

SEQ ID NO: 12359 - DNA, 25 bp, Homo sapiens
gttcctcagaaagcgtctgcagcaa

SEQ ID NO: 12360 - DNA, 25 bp, Homo sapiens
ttcctcagaaagcgtctgcagcaat

SEQ ID NO: 12361 - DNA, 25 bp, Homo sapiens
tcctcagaaagcgtctgcagcaatg

SEQ ID NO: 12362 - DNA, 25 bp, Homo sapiens
cctcagaaagcgtctgcagcaatgc

SEQ ID NO: 12363 - DNA, 25 bp, Homo sapiens
ctcagaaagcgtctgcagcaatgcg

SEQ ID NO: 12364 - DNA, 25 bp, Homo sapiens
tcagaaagcgtctgcagcaatgcga

SEQ ID NO: 12365 - DNA, 25 bp, Homo sapiens
cagaaagcgtctgcagcaatgcgag

SEQ ID NO: 12366 - DNA, 25 bp, Homo sapiens
agaaagcgtctgcagcaatgcgagg

SEQ ID NO: 12367 - DNA, 25 bp, Homo sapiens
gaaagcgtctgcagcaatgcgagga

SEQ ID NO: 12368 - DNA, 25 bp, Homo sapiens
aaagcgtctgcagcaatgcgaggag

SEQ ID NO: 12369 - DNA, 25 bp, Homo sapiens
aagcgtctgcagcaatgcgaggaga

SEQ ID NO: 12370 - DNA, 25 bp, Homo sapiens
agcgtctgcagcaatgcgaggagag

SEQ ID NO: 12371 - DNA, 25 bp, Homo sapiens
gcgtctgcagcaatgcgaggagagg

SEQ ID NO: 12372 - DNA, 25 bp, Homo sapiens
cgtctgcagcaatgcgaggagaggc

SEQ ID NO: 12373 - DNA, 25 bp, Homo sapiens
gtctgcagcaatgcgaggagaggct

SEQ ID NO: 12374 - DNA, 25 bp, Homo sapiens
tctgcagcaatgcgaggagaggctg

SEQ ID NO: 12375 - DNA, 25 bp, Homo sapiens
ctgcagcaatgcgaggagaggctgg

SEQ ID NO: 12376 - DNA, 25 bp, Homo sapiens
tgcagcaatgcgaggagaggctgga

SEQ ID NO: 12377 - DNA, 25 bp, Homo sapiens
gcagcaatgcgaggagaggctggac

SEQ ID NO: 12378 - DNA, 25 bp, Homo sapiens
cagcaatgcgaggagaggctggact

SEQ ID NO: 12379 - DNA, 25 bp, Homo sapiens
agcaatgcgaggagaggctggactc

SEQ ID NO: 12380 - DNA, 25 bp, Homo sapiens
gcaatgcgaggagaggctggactcg

SEQ ID NO: 12381 - DNA, 25 bp, Homo sapiens
caatgcgaggagaggctggactcgg

SEQ ID NO: 12382 - DNA, 25 bp, Homo sapiens
aatgcgaggagaggctggactcgga

SEQ ID NO: 12383 - DNA, 25 bp, Homo sapiens
atgcgaggagaggctggactcggag

SEQ ID NO: 12384 - DNA, 25 bp, Homo sapiens
tgcgaggagaggctggactcggagc

SEQ ID NO: 12385 - DNA, 25 bp, Homo sapiens
gcgaggagaggctggactcggagct

SEQ ID NO: 12386 - DNA, 25 bp, Homo sapiens
cgaggagaggctggactcggagctg

SEQ ID NO: 12387 - DNA, 25 bp, Homo sapiens
gaggagaggctggactcggagctga

SEQ ID NO: 12388 - DNA, 25 bp, Homo sapiens
aggagaggctggactcggagctgac

SEQ ID NO: 12389 - DNA, 25 bp, Homo sapiens
ggagaggctggactcggagctgaca

SEQ ID NO: 12390 - DNA, 25 bp, Homo sapiens
gagaggctggactcggagctgacag

SEQ ID NO: 12391 - DNA, 25 bp, Homo sapiens
agaggctggactcggagctgacagc

SEQ ID NO: 12392 - DNA, 25 bp, Homo sapiens
gaggctggactcggagctgacagcc

SEQ ID NO: 12393 - DNA, 25 bp, Homo sapiens
aggctggactcggagctgacagcca

SEQ ID NO: 12394 - DNA, 25 bp, Homo sapiens
ggctggactcggagctgacagccag

SEQ ID NO: 12395 - DNA, 25 bp, Homo sapiens
gctggactcggagctgacagccagg

SEQ ID NO: 12396 - DNA, 25 bp, Homo sapiens
ctggactcggagctgacagccagga

SEQ ID NO: 12397 - DNA, 25 bp, Homo sapiens
tggactcggagctgacagccaggaa

SEQ ID NO: 12398 - DNA, 25 bp, Homo sapiens
ggactcggagctgacagccaggaaa

SEQ ID NO: 12399 - DNA, 25 bp, Homo sapiens
gactcggagctgacagccaggaaag

SEQ ID NO: 12400 - DNA, 25 bp, Homo sapiens
actcggagctgacagccaggaaaga

SEQ ID NO: 12401 - DNA, 25 bp, Homo sapiens
ctcggagctgacagccaggaaagag

SEQ ID NO: 12402 - DNA, 25 bp, Homo sapiens
tcggagctgacagccaggaaagagc

SEQ ID NO: 12403 - DNA, 25 bp, Homo sapiens
cggagctgacagccaggaaagagct

SEQ ID NO: 12404 - DNA, 25 bp, Homo sapiens
ggagctgacagccaggaaagagctg

SEQ ID NO: 12405 - DNA, 25 bp, Homo sapiens
gagctgacagccaggaaagagctgg

SEQ ID NO: 12406 - DNA, 25 bp, Homo sapiens
agctgacagccaggaaagagctgga

SEQ ID NO: 12407 - DNA, 25 bp, Homo sapiens
gctgacagccaggaaagagctggag

SEQ ID NO: 12408 - DNA, 25 bp, Homo sapiens
ctgacagccaggaaagagctggagc

SEQ ID NO: 12409 - DNA, 25 bp, Homo sapiens
tgacagccaggaaagagctggagca

SEQ ID NO: 12410 - DNA, 25 bp, Homo sapiens
gacagccaggaaagagctggagcaa

SEQ ID NO: 12411 - DNA, 25 bp, Homo sapiens
acagccaggaaagagctggagcaaa

SEQ ID NO: 12412 - DNA, 25 bp, Homo sapiens
cagccaggaaagagctggagcaaaa

SEQ ID NO: 12413 - DNA, 25 bp, Homo sapiens
agccaggaaagagctggagcaaaag

SEQ ID NO: 12414 - DNA, 25 bp, Homo sapiens
gccaggaaagagctggagcaaaagc

SEQ ID NO: 12415 - DNA, 25 bp, Homo sapiens
ccaggaaagagctggagcaaaagct

SEQ ID NO: 12416 - DNA, 25 bp, Homo sapiens
caggaaagagctggagcaaaagctt

SEQ ID NO: 12417 - DNA, 25 bp, Homo sapiens
aggaaagagctggagcaaaagcttg

SEQ ID NO: 12418 - DNA, 25 bp, Homo sapiens
ggaaagagctggagcaaaagcttgg

SEQ ID NO: 12419 - DNA, 25 bp, Homo sapiens
gaaagagctggagcaaaagcttggg

SEQ ID NO: 12420 - DNA, 25 bp, Homo sapiens
aaagagctggagcaaaagcttgggg

SEQ ID NO: 12421 - DNA, 25 bp, Homo sapiens
aagagctggagcaaaagcttgggga

SEQ ID NO: 12422 - DNA, 25 bp, Homo sapiens
agagctggagcaaaagcttggggag

SEQ ID NO: 12423 - DNA, 25 bp, Homo sapiens
gagctggagcaaaagcttggggagt

SEQ ID NO: 12424 - DNA, 25 bp, Homo sapiens
agctggagcaaaagcttggggagtt

SEQ ID NO: 12425 - DNA, 25 bp, Homo sapiens
gctggagcaaaagcttggggagttg

SEQ ID NO: 12426 - DNA, 25 bp, Homo sapiens
ctggagcaaaagcttggggagttgc

SEQ ID NO: 12427 - DNA, 25 bp, Homo sapiens
tggagcaaaagcttggggagttgca

SEQ ID NO: 12428 - DNA, 25 bp, Homo sapiens
ggagcaaaagcttggggagttgcaa

SEQ ID NO: 12429 - DNA, 25 bp, Homo sapiens
gagcaaaagcttggggagttgcaaa

SEQ ID NO: 12430 - DNA, 25 bp, Homo sapiens
agcaaaagcttggggagttgcaaag

SEQ ID NO: 12431 - DNA, 25 bp, Homo sapiens
gcaaaagcttggggagttgcaaagt

SEQ ID NO: 12432 - DNA, 25 bp, Homo sapiens
caaaagcttggggagttgcaaagtg

SEQ ID NO: 12433 - DNA, 25 bp, Homo sapiens
aaaagcttggggagttgcaaagtgc

SEQ ID NO: 12434 - DNA, 25 bp, Homo sapiens
aaagcttggggagttgcaaagtgct

SEQ ID NO: 12435 - DNA, 25 bp, Homo sapiens
aagcttggggagttgcaaagtgctt

SEQ ID NO: 12436 - DNA, 25 bp, Homo sapiens
agcttggggagttgcaaagtgctta

SEQ ID NO: 12437 - DNA, 25 bp, Homo sapiens
gcttggggagttgcaaagtgcttat

SEQ ID NO: 12438 - DNA, 25 bp, Homo sapiens
cttggggagttgcaaagtgcttatg

SEQ ID NO: 12439 - DNA, 25 bp, Homo sapiens
ttggggagttgcaaagtgcttatga

SEQ ID NO: 12440 - DNA, 25 bp, Homo sapiens
tggggagttgcaaagtgcttatgac

SEQ ID NO: 12441 - DNA, 25 bp, Homo sapiens
ggggagttgcaaagtgcttatgacg

SEQ ID NO: 12442 - DNA, 25 bp, Homo sapiens
gggagttgcaaagtgcttatgacgg

SEQ ID NO: 12443 - DNA, 25 bp, Homo sapiens
ggagttgcaaagtgcttatgacggg

SEQ ID NO: 12444 - DNA, 25 bp, Homo sapiens
gagttgcaaagtgcttatgacgggg

SEQ ID NO: 12445 - DNA, 25 bp, Homo sapiens
agttgcaaagtgcttatgacggggc

SEQ ID NO: 12446 - DNA, 25 bp, Homo sapiens
gttgcaaagtgcttatgacggggcc

SEQ ID NO: 12447 - DNA, 25 bp, Homo sapiens
ttgcaaagtgcttatgacggggcca

SEQ ID NO: 12448 - DNA, 25 bp, Homo sapiens
tgcaaagtgcttatgacggggccaa

SEQ ID NO: 12449 - DNA, 25 bp, Homo sapiens
gcaaagtgcttatgacggggccaag

SEQ ID NO: 12450 - DNA, 25 bp, Homo sapiens
caaagtgcttatgacggggccaaga

SEQ ID NO: 12451 - DNA, 25 bp, Homo sapiens
aaagtgcttatgacggggccaagaa

SEQ ID NO: 12452 - DNA, 25 bp, Homo sapiens
aagtgcttatgacggggccaagaag

SEQ ID NO: 12453 - DNA, 25 bp, Homo sapiens
agtgcttatgacggggccaagaaga

SEQ ID NO: 12454 - DNA, 25 bp, Homo sapiens
gtgcttatgacggggccaagaagat

SEQ ID NO: 12455 - DNA, 25 bp, Homo sapiens
tgcttatgacggggccaagaagatg

SEQ ID NO: 12456 - DNA, 25 bp, Homo sapiens
gcttatgacggggccaagaagatgg

SEQ ID NO: 12457 - DNA, 25 bp, Homo sapiens
cttatgacggggccaagaagatggc

SEQ ID NO: 12458 - DNA, 25 bp, Homo sapiens
ttatgacggggccaagaagatggct

SEQ ID NO: 12459 - DNA, 25 bp, Homo sapiens
tatgacggggccaagaagatggctc

SEQ ID NO: 12460 - DNA, 25 bp, Homo sapiens
atgacggggccaagaagatggctca

SEQ ID NO: 12461 - DNA, 25 bp, Homo sapiens
tgacggggccaagaagatggctcac

SEQ ID NO: 12462 - DNA, 25 bp, Homo sapiens
gacggggccaagaagatggctcacc

SEQ ID NO: 12463 - DNA, 25 bp, Homo sapiens
acggggccaagaagatggctcacca

SEQ ID NO: 12464 - DNA, 25 bp, Homo sapiens
cggggccaagaagatggctcaccaa

SEQ ID NO: 12465 - DNA, 25 bp, Homo sapiens
ggggccaagaagatggctcaccaac

SEQ ID NO: 12466 - DNA, 25 bp, Homo sapiens
gggccaagaagatggctcaccaact

SEQ ID NO: 12467 - DNA, 25 bp, Homo sapiens
ggccaagaagatggctcaccaactg

SEQ ID NO: 12468 - DNA, 25 bp, Homo sapiens
gccaagaagatggctcaccaactga

SEQ ID NO: 12469 - DNA, 25 bp, Homo sapiens
ccaagaagatggctcaccaactgaa

SEQ ID NO: 12470 - DNA, 25 bp, Homo sapiens
caagaagatggctcaccaactgaag

SEQ ID NO: 12471 - DNA, 25 bp, Homo sapiens
aagaagatggctcaccaactgaaga

SEQ ID NO: 12472 - DNA, 25 bp, Homo sapiens
agaagatggctcaccaactgaagag

SEQ ID NO: 12473 - DNA, 25 bp, Homo sapiens
gaagatggctcaccaactgaagagg

SEQ ID NO: 12474 - DNA, 25 bp, Homo sapiens
aagatggctcaccaactgaagagga

SEQ ID NO: 12475 - DNA, 25 bp, Homo sapiens
agatggctcaccaactgaagaggaa

SEQ ID NO: 12476 - DNA, 25 bp, Homo sapiens
gatggctcaccaactgaagaggaag

SEQ ID NO: 12477 - DNA, 25 bp, Homo sapiens
atggctcaccaactgaagaggaagt

SEQ ID NO: 12478 - DNA, 25 bp, Homo sapiens
tggctcaccaactgaagaggaagtg

SEQ ID NO: 12479 - DNA, 25 bp, Homo sapiens
ggctcaccaactgaagaggaagtgc

SEQ ID NO: 12480 - DNA, 25 bp, Homo sapiens
gctcaccaactgaagaggaagtgcc

SEQ ID NO: 12481 - DNA, 25 bp, Homo sapiens
ctcaccaactgaagaggaagtgcca

SEQ ID NO: 12482 - DNA, 25 bp, Homo sapiens
tcaccaactgaagaggaagtgccac

SEQ ID NO: 12483 - DNA, 25 bp, Homo sapiens
caccaactgaagaggaagtgccacc

SEQ ID NO: 12484 - DNA, 25 bp, Homo sapiens
accaactgaagaggaagtgccacca

SEQ ID NO: 12485 - DNA, 25 bp, Homo sapiens
ccaactgaagaggaagtgccaccat

SEQ ID NO: 12486 - DNA, 25 bp, Homo sapiens
caactgaagaggaagtgccaccatc

SEQ ID NO: 12487 - DNA, 25 bp, Homo sapiens
aactgaagaggaagtgccaccatct

SEQ ID NO: 12488 - DNA, 25 bp, Homo sapiens
actgaagaggaagtgccaccatctt

SEQ ID NO: 12489 - DNA, 25 bp, Homo sapiens
ctgaagaggaagtgccaccatctta

SEQ ID NO: 12490 - DNA, 25 bp, Homo sapiens
tgaagaggaagtgccaccatcttac

SEQ ID NO: 12491 - DNA, 25 bp, Homo sapiens
gaagaggaagtgccaccatcttacc

SEQ ID NO: 12492 - DNA, 25 bp, Homo sapiens
aagaggaagtgccaccatcttacct

SEQ ID NO: 12493 - DNA, 25 bp, Homo sapiens
agaggaagtgccaccatcttacctg

SEQ ID NO: 12494 - DNA, 25 bp, Homo sapiens
gaggaagtgccaccatcttacctgt

SEQ ID NO: 12495 - DNA, 25 bp, Homo sapiens
aggaagtgccaccatcttacctgtg

SEQ ID NO: 12496 - DNA, 25 bp, Homo sapiens
ggaagtgccaccatcttacctgtga

SEQ ID NO: 12497 - DNA, 25 bp, Homo sapiens
gaagtgccaccatcttacctgtgac

SEQ ID NO: 12498 - DNA, 25 bp, Homo sapiens
aagtgccaccatcttacctgtgacc

SEQ ID NO: 12499 - DNA, 25 bp, Homo sapiens
agtgccaccatcttacctgtgacct

SEQ ID NO: 12500 - DNA, 25 bp, Homo sapiens
gtgccaccatcttacctgtgacctt

SEQ ID NO: 12501 - DNA, 25 bp, Homo sapiens
tgccaccatcttacctgtgaccttg

SEQ ID NO: 12502 - DNA, 25 bp, Homo sapiens
gccaccatcttacctgtgaccttga

SEQ ID NO: 12503 - DNA, 25 bp, Homo sapiens
ccaccatcttacctgtgaccttgag

SEQ ID NO: 12504 - DNA, 25 bp, Homo sapiens
caccatcttacctgtgaccttgagg

SEQ ID NO: 12505 - DNA, 25 bp, Homo sapiens
accatcttacctgtgaccttgagga

SEQ ID NO: 12506 - DNA, 25 bp, Homo sapiens
ccatcttacctgtgaccttgaggat

SEQ ID NO: 12507 - DNA, 25 bp, Homo sapiens
catcttacctgtgaccttgaggata

SEQ ID NO: 12508 - DNA, 25 bp, Homo sapiens
atcttacctgtgaccttgaggatac

SEQ ID NO: 12509 - DNA, 25 bp, Homo sapiens
tcttacctgtgaccttgaggatacc

SEQ ID NO: 12510 - DNA, 25 bp, Homo sapiens
cttacctgtgaccttgaggatacct

SEQ ID NO: 12511 - DNA, 25 bp, Homo sapiens
ttacctgtgaccttgaggatacctg

SEQ ID NO: 12512 - DNA, 25 bp, Homo sapiens
tacctgtgaccttgaggatacctgc

SEQ ID NO: 12513 - DNA, 25 bp, Homo sapiens
acctgtgaccttgaggatacctgcg

SEQ ID NO: 12514 - DNA, 25 bp, Homo sapiens
cctgtgaccttgaggatacctgcgt

SEQ ID NO: 12515 - DNA, 25 bp, Homo sapiens
ctgtgaccttgaggatacctgcgtc

SEQ ID NO: 12516 - DNA, 25 bp, Homo sapiens
tgtgaccttgaggatacctgcgtcc

SEQ ID NO: 12517 - DNA, 25 bp, Homo sapiens
gtgaccttgaggatacctgcgtcct

SEQ ID NO: 12518 - DNA, 25 bp, Homo sapiens
tgaccttgaggatacctgcgtcctg

SEQ ID NO: 12519 - DNA, 25 bp, Homo sapiens
gaccttgaggatacctgcgtcctgc

SEQ ID NO: 12520 - DNA, 25 bp, Homo sapiens
accttgaggatacctgcgtcctgct

SEQ ID NO: 12521 - DNA, 25 bp, Homo sapiens
ccttgaggatacctgcgtcctgcta

SEQ ID NO: 12522 - DNA, 25 bp, Homo sapiens
cttgaggatacctgcgtcctgctag

SEQ ID NO: 12523 - DNA, 25 bp, Homo sapiens
ttgaggatacctgcgtcctgctaga

SEQ ID NO: 12524 - DNA, 25 bp, Homo sapiens
tgaggatacctgcgtcctgctagag

SEQ ID NO: 12525 - DNA, 25 bp, Homo sapiens
gaggatacctgcgtcctgctagaga

SEQ ID NO: 12526 - DNA, 25 bp, Homo sapiens
aggatacctgcgtcctgctagagaa

SEQ ID NO: 12527 - DNA, 25 bp, Homo sapiens
ggatacctgcgtcctgctagagaac

SEQ ID NO: 12528 - DNA, 25 bp, Homo sapiens
gatacctgcgtcctgctagagaacc

SEQ ID NO: 12529 - DNA, 25 bp, Homo sapiens
atacctgcgtcctgctagagaacca

SEQ ID NO: 12530 - DNA, 25 bp, Homo sapiens
tacctgcgtcctgctagagaaccaa

SEQ ID NO: 12531 - DNA, 25 bp, Homo sapiens
acctgcgtcctgctagagaaccaac

SEQ ID NO: 12532 - DNA, 25 bp, Homo sapiens
cctgcgtcctgctagagaaccaaca

SEQ ID NO: 12533 - DNA, 25 bp, Homo sapiens
ctgcgtcctgctagagaaccaacaa

SEQ ID NO: 12534 - DNA, 25 bp, Homo sapiens
tgcgtcctgctagagaaccaacaaa

SEQ ID NO: 12535 - DNA, 25 bp, Homo sapiens
gcgtcctgctagagaaccaacaaag

SEQ ID NO: 12536 - DNA, 25 bp, Homo sapiens
cgtcctgctagagaaccaacaaagt

SEQ ID NO: 12537 - DNA, 25 bp, Homo sapiens
gtcctgctagagaaccaacaaagtc

SEQ ID NO: 12538 - DNA, 25 bp, Homo sapiens
tcctgctagagaaccaacaaagtcg

SEQ ID NO: 12539 - DNA, 25 bp, Homo sapiens
cctgctagagaaccaacaaagtcga

SEQ ID NO: 12540 - DNA, 25 bp, Homo sapiens
ctgctagagaaccaacaaagtcgaa

SEQ ID NO: 12541 - DNA, 25 bp, Homo sapiens
tgctagagaaccaacaaagtcgaaa

SEQ ID NO: 12542 - DNA, 25 bp, Homo sapiens
gctagagaaccaacaaagtcgaaac

SEQ ID NO: 12543 - DNA, 25 bp, Homo sapiens
ctagagaaccaacaaagtcgaaacc

SEQ ID NO: 12544 - DNA, 25 bp, Homo sapiens
tagagaaccaacaaagtcgaaacca

SEQ ID NO: 12545 - DNA, 25 bp, Homo sapiens
agagaaccaacaaagtcgaaaccat

SEQ ID NO: 12546 - DNA, 25 bp, Homo sapiens
gagaaccaacaaagtcgaaaccatg

SEQ ID NO: 12547 - DNA, 25 bp, Homo sapiens
agaaccaacaaagtcgaaaccatga

SEQ ID NO: 12548 - DNA, 25 bp, Homo sapiens
gaaccaacaaagtcgaaaccatgag

SEQ ID NO: 12549 - DNA, 25 bp, Homo sapiens
aaccaacaaagtcgaaaccatgagc

SEQ ID NO: 12550 - DNA, 25 bp, Homo sapiens
accaacaaagtcgaaaccatgagct

SEQ ID NO: 12551 - DNA, 25 bp, Homo sapiens
ccaacaaagtcgaaaccatgagctg

SEQ ID NO: 12552 - DNA, 25 bp, Homo sapiens
caacaaagtcgaaaccatgagctgg

SEQ ID NO: 12553 - DNA, 25 bp, Homo sapiens
aacaaagtcgaaaccatgagctgga

SEQ ID NO: 12554 - DNA, 25 bp, Homo sapiens
acaaagtcgaaaccatgagctggag

SEQ ID NO: 12555 - DNA, 25 bp, Homo sapiens
caaagtcgaaaccatgagctggaga

SEQ ID NO: 12556 - DNA, 25 bp, Homo sapiens
aaagtcgaaaccatgagctggagaa

SEQ ID NO: 12557 - DNA, 25 bp, Homo sapiens
aagtcgaaaccatgagctggagaag

SEQ ID NO: 12558 - DNA, 25 bp, Homo sapiens
agtcgaaaccatgagctggagaaga

SEQ ID NO: 12559 - DNA, 25 bp, Homo sapiens
gtcgaaaccatgagctggagaagaa

SEQ ID NO: 12560 - DNA, 25 bp, Homo sapiens
tcgaaaccatgagctggagaagaag

SEQ ID NO: 12561 - DNA, 25 bp, Homo sapiens
cgaaaccatgagctggagaagaagc

SEQ ID NO: 12562 - DNA, 25 bp, Homo sapiens
gaaaccatgagctggagaagaagca

SEQ ID NO: 12563 - DNA, 25 bp, Homo sapiens
aaaccatgagctggagaagaagcag

SEQ ID NO: 12564 - DNA, 25 bp, Homo sapiens
aaccatgagctggagaagaagcaga

SEQ ID NO: 12565 - DNA, 25 bp, Homo sapiens
accatgagctggagaagaagcagaa

SEQ ID NO: 12566 - DNA, 25 bp, Homo sapiens
ccatgagctggagaagaagcagaag

SEQ ID NO: 12567 - DNA, 25 bp, Homo sapiens
catgagctggagaagaagcagaaga

SEQ ID NO: 12568 - DNA, 25 bp, Homo sapiens
atgagctggagaagaagcagaagaa

SEQ ID NO: 12569 - DNA, 25 bp, Homo sapiens
tgagctggagaagaagcagaagaag

SEQ ID NO: 12570 - DNA, 25 bp, Homo sapiens
gagctggagaagaagcagaagaagt

SEQ ID NO: 12571 - DNA, 25 bp, Homo sapiens
agctggagaagaagcagaagaagtt

SEQ ID NO: 12572 - DNA, 25 bp, Homo sapiens
gctggagaagaagcagaagaagttt

SEQ ID NO: 12573 - DNA, 25 bp, Homo sapiens
ctggagaagaagcagaagaagtttg

SEQ ID NO: 12574 - DNA, 25 bp, Homo sapiens
tggagaagaagcagaagaagtttga

SEQ ID NO: 12575 - DNA, 25 bp, Homo sapiens
ggagaagaagcagaagaagtttgac

SEQ ID NO: 12576 - DNA, 25 bp, Homo sapiens
gagaagaagcagaagaagtttgacc

SEQ ID NO: 12577 - DNA, 25 bp, Homo sapiens
agaagaagcagaagaagtttgacct

SEQ ID NO: 12578 - DNA, 25 bp, Homo sapiens
gaagaagcagaagaagtttgacctg

SEQ ID NO: 12579 - DNA, 25 bp, Homo sapiens
aagaagcagaagaagtttgacctgc

SEQ ID NO: 12580 - DNA, 25 bp, Homo sapiens
agaagcagaagaagtttgacctgca

SEQ ID NO: 12581 - DNA, 25 bp, Homo sapiens
gaagcagaagaagtttgacctgcag

SEQ ID NO: 12582 - DNA, 25 bp, Homo sapiens
aagcagaagaagtttgacctgcagc

SEQ ID NO: 12583 - DNA, 25 bp, Homo sapiens
agcagaagaagtttgacctgcagct

SEQ ID NO: 12584 - DNA, 25 bp, Homo sapiens
gcagaagaagtttgacctgcagctg

SEQ ID NO: 12585 - DNA, 25 bp, Homo sapiens
cagaagaagtttgacctgcagctgg

SEQ ID NO: 12586 - DNA, 25 bp, Homo sapiens
agaagaagtttgacctgcagctggc

SEQ ID NO: 12587 - DNA, 25 bp, Homo sapiens
gaagaagtttgacctgcagctggcc

SEQ ID NO: 12588 - DNA, 25 bp, Homo sapiens
aagaagtttgacctgcagctggccc

SEQ ID NO: 12589 - DNA, 25 bp, Homo sapiens
agaagtttgacctgcagctggccca

SEQ ID NO: 12590 - DNA, 25 bp, Homo sapiens
gaagtttgacctgcagctggcccag

SEQ ID NO: 12591 - DNA, 25 bp, Homo sapiens
aagtttgacctgcagctggcccagg

SEQ ID NO: 12592 - DNA, 25 bp, Homo sapiens
agtttgacctgcagctggcccaggc

SEQ ID NO: 12593 - DNA, 25 bp, Homo sapiens
gtttgacctgcagctggcccaggcc

SEQ ID NO: 12594 - DNA, 25 bp, Homo sapiens
tttgacctgcagctggcccaggccc

SEQ ID NO: 12595 - DNA, 25 bp, Homo sapiens
ttgacctgcagctggcccaggccct

SEQ ID NO: 12596 - DNA, 25 bp, Homo sapiens
tgacctgcagctggcccaggcccta

SEQ ID NO: 12597 - DNA, 25 bp, Homo sapiens
gacctgcagctggcccaggccctag

SEQ ID NO: 12598 - DNA, 25 bp, Homo sapiens
acctgcagctggcccaggccctagg

SEQ ID NO: 12599 - DNA, 25 bp, Homo sapiens
cctgcagctggcccaggccctaggt

SEQ ID NO: 12600 - DNA, 25 bp, Homo sapiens
ctgcagctggcccaggccctaggtg

SEQ ID NO: 12601 - DNA, 25 bp, Homo sapiens
tgcagctggcccaggccctaggtga

SEQ ID NO: 12602 - DNA, 25 bp, Homo sapiens
gcagctggcccaggccctaggtgag

SEQ ID NO: 12603 - DNA, 25 bp, Homo sapiens
cagctggcccaggccctaggtgagt

SEQ ID NO: 12604 - DNA, 25 bp, Homo sapiens
agctggcccaggccctaggtgagtc

SEQ ID NO: 12605 - DNA, 25 bp, Homo sapiens
gctggcccaggccctaggtgagtca

SEQ ID NO: 12606 - DNA, 25 bp, Homo sapiens
ctggcccaggccctaggtgagtcag

SEQ ID NO: 12607 - DNA, 25 bp, Homo sapiens
tggcccaggccctaggtgagtcagt

SEQ ID NO: 12608 - DNA, 25 bp, Homo sapiens
ggcccaggccctaggtgagtcagtg

SEQ ID NO: 12609 - DNA, 25 bp, Homo sapiens
gcccaggccctaggtgagtcagtgt

SEQ ID NO: 12610 - DNA, 25 bp, Homo sapiens
cccaggccctaggtgagtcagtgtt

SEQ ID NO: 12611 - DNA, 25 bp, Homo sapiens
ccaggccctaggtgagtcagtgttt

SEQ ID NO: 12612 - DNA, 25 bp, Homo sapiens
caggccctaggtgagtcagtgtttg

SEQ ID NO: 12613 - DNA, 25 bp, Homo sapiens
aggccctaggtgagtcagtgtttga

SEQ ID NO: 12614 - DNA, 25 bp, Homo sapiens
ggccctaggtgagtcagtgtttgag

SEQ ID NO: 12615 - DNA, 25 bp, Homo sapiens
gccctaggtgagtcagtgtttgaga

SEQ ID NO: 12616 - DNA, 25 bp, Homo sapiens
ccctaggtgagtcagtgtttgagaa

SEQ ID NO: 12617 - DNA, 25 bp, Homo sapiens
cctaggtgagtcagtgtttgagaag

SEQ ID NO: 12618 - DNA, 25 bp, Homo sapiens
ctaggtgagtcagtgtttgagaagg

SEQ ID NO: 12619 - DNA, 25 bp, Homo sapiens
taggtgagtcagtgtttgagaaggg

SEQ ID NO: 12620 - DNA, 25 bp, Homo sapiens
aggtgagtcagtgtttgagaagggt

SEQ ID NO: 12621 - DNA, 25 bp, Homo sapiens
ggtgagtcagtgtttgagaagggtc

SEQ ID NO: 12622 - DNA, 25 bp, Homo sapiens
gtgagtcagtgtttgagaagggtct

SEQ ID NO: 12623 - DNA, 25 bp, Homo sapiens
tgagtcagtgtttgagaagggtctc

SEQ ID NO: 12624 - DNA, 25 bp, Homo sapiens
gagtcagtgtttgagaagggtctcc

SEQ ID NO: 12625 - DNA, 25 bp, Homo sapiens
agtcagtgtttgagaagggtctccg

SEQ ID NO: 12626 - DNA, 25 bp, Homo sapiens
gtcagtgtttgagaagggtctccgt

SEQ ID NO: 12627 - DNA, 25 bp, Homo sapiens
tcagtgtttgagaagggtctccgtg

SEQ ID NO: 12628 - DNA, 25 bp, Homo sapiens
cagtgtttgagaagggtctccgtga

SEQ ID NO: 12629 - DNA, 25 bp, Homo sapiens
agtgtttgagaagggtctccgtgag

SEQ ID NO: 12630 - DNA, 25 bp, Homo sapiens
gtgtttgagaagggtctccgtgaga

SEQ ID NO: 12631 - DNA, 25 bp, Homo sapiens
tgtttgagaagggtctccgtgagaa

SEQ ID NO: 12632 - DNA, 25 bp, Homo sapiens
gtttgagaagggtctccgtgagaaa

SEQ ID NO: 12633 - DNA, 25 bp, Homo sapiens
tttgagaagggtctccgtgagaaag

SEQ ID NO: 12634 - DNA, 25 bp, Homo sapiens
ttgagaagggtctccgtgagaaagt

SEQ ID NO: 12635 - DNA, 25 bp, Homo sapiens
tgagaagggtctccgtgagaaagtg

SEQ ID NO: 12636 - DNA, 25 bp, Homo sapiens
gagaagggtctccgtgagaaagtga

SEQ ID NO: 12637 - DNA, 25 bp, Homo sapiens
agaagggtctccgtgagaaagtgac

SEQ ID NO: 12638 - DNA, 25 bp, Homo sapiens
gaagggtctccgtgagaaagtgacc

SEQ ID NO: 12639 - DNA, 25 bp, Homo sapiens
aagggtctccgtgagaaagtgaccc

SEQ ID NO: 12640 - DNA, 25 bp, Homo sapiens
agggtctccgtgagaaagtgaccca

SEQ ID NO: 12641 - DNA, 25 bp, Homo sapiens
gggtctccgtgagaaagtgacccag

SEQ ID NO: 12642 - DNA, 25 bp, Homo sapiens
ggtctccgtgagaaagtgacccagg

SEQ ID NO: 12643 - DNA, 25 bp, Homo sapiens
gtctccgtgagaaagtgacccagga

SEQ ID NO: 12644 - DNA, 25 bp, Homo sapiens
tctccgtgagaaagtgacccaggag

SEQ ID NO: 12645 - DNA, 25 bp, Homo sapiens
ctccgtgagaaagtgacccaggaga

SEQ ID NO: 12646 - DNA, 25 bp, Homo sapiens
tccgtgagaaagtgacccaggagaa

SEQ ID NO: 12647 - DNA, 25 bp, Homo sapiens
ccgtgagaaagtgacccaggagaac

SEQ ID NO: 12648 - DNA, 25 bp, Homo sapiens
cgtgagaaagtgacccaggagaaca

SEQ ID NO: 12649 - DNA, 25 bp, Homo sapiens
gtgagaaagtgacccaggagaacac

SEQ ID NO: 12650 - DNA, 25 bp, Homo sapiens
tgagaaagtgacccaggagaacacc

SEQ ID NO: 12651 - DNA, 25 bp, Homo sapiens
gagaaagtgacccaggagaacacca

SEQ ID NO: 12652 - DNA, 25 bp, Homo sapiens
agaaagtgacccaggagaacaccag

SEQ ID NO: 12653 - DNA, 25 bp, Homo sapiens
gaaagtgacccaggagaacaccagt

SEQ ID NO: 12654 - DNA, 25 bp, Homo sapiens
aaagtgacccaggagaacaccagtg

SEQ ID NO: 12655 - DNA, 25 bp, Homo sapiens
aagtgacccaggagaacaccagtgt

SEQ ID NO: 12656 - DNA, 25 bp, Homo sapiens
agtgacccaggagaacaccagtgtc

SEQ ID NO: 12657 - DNA, 25 bp, Homo sapiens
gtgacccaggagaacaccagtgtcc

SEQ ID NO: 12658 - DNA, 25 bp, Homo sapiens
tgacccaggagaacaccagtgtccg

SEQ ID NO: 12659 - DNA, 25 bp, Homo sapiens
gacccaggagaacaccagtgtccgg

SEQ ID NO: 12660 - DNA, 25 bp, Homo sapiens
acccaggagaacaccagtgtccggt

SEQ ID NO: 12661 - DNA, 25 bp, Homo sapiens
cccaggagaacaccagtgtccggtg

SEQ ID NO: 12662 - DNA, 25 bp, Homo sapiens
ccaggagaacaccagtgtccggtgg

SEQ ID NO: 12663 - DNA, 25 bp, Homo sapiens
caggagaacaccagtgtccggtggg

SEQ ID NO: 12664 - DNA, 25 bp, Homo sapiens
aggagaacaccagtgtccggtggga

SEQ ID NO: 12665 - DNA, 25 bp, Homo sapiens
ggagaacaccagtgtccggtgggag

SEQ ID NO: 12666 - DNA, 25 bp, Homo sapiens
gagaacaccagtgtccggtgggagc

SEQ ID NO: 12667 - DNA, 25 bp, Homo sapiens
agaacaccagtgtccggtgggagct

SEQ ID NO: 12668 - DNA, 25 bp, Homo sapiens
gaacaccagtgtccggtgggagcta

SEQ ID NO: 12669 - DNA, 25 bp, Homo sapiens
aacaccagtgtccggtgggagctag

SEQ ID NO: 12670 - DNA, 25 bp, Homo sapiens
acaccagtgtccggtgggagctagg

SEQ ID NO: 12671 - DNA, 25 bp, Homo sapiens
caccagtgtccggtgggagctaggc

SEQ ID NO: 12672 - DNA, 25 bp, Homo sapiens
accagtgtccggtgggagctaggcc

SEQ ID NO: 12673 - DNA, 25 bp, Homo sapiens
ccagtgtccggtgggagctaggcca

SEQ ID NO: 12674 - DNA, 25 bp, Homo sapiens
cagtgtccggtgggagctaggccag

SEQ ID NO: 12675 - DNA, 25 bp, Homo sapiens
agtgtccggtgggagctaggccagc

SEQ ID NO: 12676 - DNA, 25 bp, Homo sapiens
gtgtccggtgggagctaggccagct

SEQ ID NO: 12677 - DNA, 25 bp, Homo sapiens
tgtccggtgggagctaggccagctt

SEQ ID NO: 12678 - DNA, 25 bp, Homo sapiens
gtccggtgggagctaggccagcttc

SEQ ID NO: 12679 - DNA, 25 bp, Homo sapiens
tccggtgggagctaggccagcttca

SEQ ID NO: 12680 - DNA, 25 bp, Homo sapiens
ccggtgggagctaggccagcttcag

SEQ ID NO: 12681 - DNA, 25 bp, Homo sapiens
cggtgggagctaggccagcttcagc

SEQ ID NO: 12682 - DNA, 25 bp, Homo sapiens
ggtgggagctaggccagcttcagca

SEQ ID NO: 12683 - DNA, 25 bp, Homo sapiens
gtgggagctaggccagcttcagcag

SEQ ID NO: 12684 - DNA, 25 bp, Homo sapiens
tgggagctaggccagcttcagcagc

SEQ ID NO: 12685 - DNA, 25 bp, Homo sapiens
gggagctaggccagcttcagcagca

SEQ ID NO: 12686 - DNA, 25 bp, Homo sapiens
ggagctaggccagcttcagcagcag

SEQ ID NO: 12687 - DNA, 25 bp, Homo sapiens
gagctaggccagcttcagcagcagc

SEQ ID NO: 12688 - DNA, 25 bp, Homo sapiens
agctaggccagcttcagcagcagct

SEQ ID NO: 12689 - DNA, 25 bp, Homo sapiens
gctaggccagcttcagcagcagctg

SEQ ID NO: 12690 - DNA, 25 bp, Homo sapiens
ctaggccagcttcagcagcagctga

SEQ ID NO: 12691 - DNA, 25 bp, Homo sapiens
taggccagcttcagcagcagctgaa

SEQ ID NO: 12692 - DNA, 25 bp, Homo sapiens
aggccagcttcagcagcagctgaag

SEQ ID NO: 12693 - DNA, 25 bp, Homo sapiens
ggccagcttcagcagcagctgaagc

SEQ ID NO: 12694 - DNA, 25 bp, Homo sapiens
gccagcttcagcagcagctgaagca

SEQ ID NO: 12695 - DNA, 25 bp, Homo sapiens
ccagcttcagcagcagctgaagcaa

SEQ ID NO: 12696 - DNA, 25 bp, Homo sapiens
cagcttcagcagcagctgaagcaaa

SEQ ID NO: 12697 - DNA, 25 bp, Homo sapiens
agcttcagcagcagctgaagcaaaa

SEQ ID NO: 12698 - DNA, 25 bp, Homo sapiens
gcttcagcagcagctgaagcaaaag

SEQ ID NO: 12699 - DNA, 25 bp, Homo sapiens
cttcagcagcagctgaagcaaaagg

SEQ ID NO: 12700 - DNA, 25 bp, Homo sapiens
ttcagcagcagctgaagcaaaagga

SEQ ID NO: 12701 - DNA, 25 bp, Homo sapiens
tcagcagcagctgaagcaaaaggag

SEQ ID NO: 12702 - DNA, 25 bp, Homo sapiens
cagcagcagctgaagcaaaaggagc

SEQ ID NO: 12703 - DNA, 25 bp, Homo sapiens
agcagcagctgaagcaaaaggagca

SEQ ID NO: 12704 - DNA, 25 bp, Homo sapiens
gcagcagctgaagcaaaaggagcag

SEQ ID NO: 12705 - DNA, 25 bp, Homo sapiens
cagcagctgaagcaaaaggagcagg

SEQ ID NO: 12706 - DNA, 25 bp, Homo sapiens
agcagctgaagcaaaaggagcagga

SEQ ID NO: 12707 - DNA, 25 bp, Homo sapiens
gcagctgaagcaaaaggagcaggaa

SEQ ID NO: 12708 - DNA, 25 bp, Homo sapiens
cagctgaagcaaaaggagcaggaag

SEQ ID NO: 12709 - DNA, 25 bp, Homo sapiens
agctgaagcaaaaggagcaggaagc

SEQ ID NO: 12710 - DNA, 25 bp, Homo sapiens
gctgaagcaaaaggagcaggaagcc

SEQ ID NO: 12711 - DNA, 25 bp, Homo sapiens
ctgaagcaaaaggagcaggaagcct

SEQ ID NO: 12712 - DNA, 25 bp, Homo sapiens
tgaagcaaaaggagcaggaagcctc

SEQ ID NO: 12713 - DNA, 25 bp, Homo sapiens
gaagcaaaaggagcaggaagcctca

SEQ ID NO: 12714 - DNA, 25 bp, Homo sapiens
aagcaaaaggagcaggaagcctcac

SEQ ID NO: 12715 - DNA, 25 bp, Homo sapiens
agcaaaaggagcaggaagcctcaca

SEQ ID NO: 12716 - DNA, 25 bp, Homo sapiens
gcaaaaggagcaggaagcctcacag

SEQ ID NO: 12717 - DNA, 25 bp, Homo sapiens
caaaaggagcaggaagcctcacagc

SEQ ID NO: 12718 - DNA, 25 bp, Homo sapiens
aaaaggagcaggaagcctcacagct

SEQ ID NO: 12719 - DNA, 25 bp, Homo sapiens
aaaggagcaggaagcctcacagctg

SEQ ID NO: 12720 - DNA, 25 bp, Homo sapiens
aaggagcaggaagcctcacagctga

SEQ ID NO: 12721 - DNA, 25 bp, Homo sapiens
aggagcaggaagcctcacagctgaa

SEQ ID NO: 12722 - DNA, 25 bp, Homo sapiens
ggagcaggaagcctcacagctgaag

SEQ ID NO: 12723 - DNA, 25 bp, Homo sapiens
gagcaggaagcctcacagctgaagc

SEQ ID NO: 12724 - DNA, 25 bp, Homo sapiens
agcaggaagcctcacagctgaagca

SEQ ID NO: 12725 - DNA, 25 bp, Homo sapiens
gcaggaagcctcacagctgaagcag

SEQ ID NO: 12726 - DNA, 25 bp, Homo sapiens
caggaagcctcacagctgaagcagc

SEQ ID NO: 12727 - DNA, 25 bp, Homo sapiens
aggaagcctcacagctgaagcagca

SEQ ID NO: 12728 - DNA, 25 bp, Homo sapiens
ggaagcctcacagctgaagcagcag

SEQ ID NO: 12729 - DNA, 25 bp, Homo sapiens
gaagcctcacagctgaagcagcagg

SEQ ID NO: 12730 - DNA, 25 bp, Homo sapiens
aagcctcacagctgaagcagcaggt

SEQ ID NO: 12731 - DNA, 25 bp, Homo sapiens
agcctcacagctgaagcagcaggtg

SEQ ID NO: 12732 - DNA, 25 bp, Homo sapiens
gcctcacagctgaagcagcaggtgg

SEQ ID NO: 12733 - DNA, 25 bp, Homo sapiens
cctcacagctgaagcagcaggtgga

SEQ ID NO: 12734 - DNA, 25 bp, Homo sapiens
ctcacagctgaagcagcaggtggag

SEQ ID NO: 12735 - DNA, 25 bp, Homo sapiens
tcacagctgaagcagcaggtggaga

SEQ ID NO: 12736 - DNA, 25 bp, Homo sapiens
cacagctgaagcagcaggtggagat

SEQ ID NO: 12737 - DNA, 25 bp, Homo sapiens
acagctgaagcagcaggtggagatg

SEQ ID NO: 12738 - DNA, 25 bp, Homo sapiens
cagctgaagcagcaggtggagatgc

SEQ ID NO: 12739 - DNA, 25 bp, Homo sapiens
agctgaagcagcaggtggagatgct

SEQ ID NO: 12740 - DNA, 25 bp, Homo sapiens
gctgaagcagcaggtggagatgcta

SEQ ID NO: 12741 - DNA, 25 bp, Homo sapiens
ctgaagcagcaggtggagatgctac

SEQ ID NO: 12742 - DNA, 25 bp, Homo sapiens
tgaagcagcaggtggagatgctaca

SEQ ID NO: 12743 - DNA, 25 bp, Homo sapiens
gaagcagcaggtggagatgctacag

SEQ ID NO: 12744 - DNA, 25 bp, Homo sapiens
aagcagcaggtggagatgctacagg

SEQ ID NO: 12745 - DNA, 25 bp, Homo sapiens
agcagcaggtggagatgctacagga

SEQ ID NO: 12746 - DNA, 25 bp, Homo sapiens
gcagcaggtggagatgctacaggac

SEQ ID NO: 12747 - DNA, 25 bp, Homo sapiens
cagcaggtggagatgctacaggacc

SEQ ID NO: 12748 - DNA, 25 bp, Homo sapiens
agcaggtggagatgctacaggacca

SEQ ID NO: 12749 - DNA, 25 bp, Homo sapiens
gcaggtggagatgctacaggaccat

SEQ ID NO: 12750 - DNA, 25 bp, Homo sapiens
caggtggagatgctacaggaccata

SEQ ID NO: 12751 - DNA, 25 bp, Homo sapiens
aggtggagatgctacaggaccataa

SEQ ID NO: 12752 - DNA, 25 bp, Homo sapiens
ggtggagatgctacaggaccataaa

SEQ ID NO: 12753 - DNA, 25 bp, Homo sapiens
gtggagatgctacaggaccataaac

SEQ ID NO: 12754 - DNA, 25 bp, Homo sapiens
tggagatgctacaggaccataaacg

SEQ ID NO: 12755 - DNA, 25 bp, Homo sapiens
ggagatgctacaggaccataaacgg

SEQ ID NO: 12756 - DNA, 25 bp, Homo sapiens
gagatgctacaggaccataaacggg

SEQ ID NO: 12757 - DNA, 25 bp, Homo sapiens
agatgctacaggaccataaacggga

SEQ ID NO: 12758 - DNA, 25 bp, Homo sapiens
gatgctacaggaccataaacgggag

SEQ ID NO: 12759 - DNA, 25 bp, Homo sapiens
atgctacaggaccataaacgggagc

SEQ ID NO: 12760 - DNA, 25 bp, Homo sapiens
tgctacaggaccataaacgggagct

SEQ ID NO: 12761 - DNA, 25 bp, Homo sapiens
gctacaggaccataaacgggagctg

SEQ ID NO: 12762 - DNA, 25 bp, Homo sapiens
ctacaggaccataaacgggagctgc

SEQ ID NO: 12763 - DNA, 25 bp, Homo sapiens
tacaggaccataaacgggagctgct

SEQ ID NO: 12764 - DNA, 25 bp, Homo sapiens
acaggaccataaacgggagctgctg

SEQ ID NO: 12765 - DNA, 25 bp, Homo sapiens
caggaccataaacgggagctgctgg

SEQ ID NO: 12766 - DNA, 25 bp, Homo sapiens
aggaccataaacgggagctgctggg

SEQ ID NO: 12767 - DNA, 25 bp, Homo sapiens
ggaccataaacgggagctgctgggg

SEQ ID NO: 12768 - DNA, 25 bp, Homo sapiens
gaccataaacgggagctgctggggt

SEQ ID NO: 12769 - DNA, 25 bp, Homo sapiens
accataaacgggagctgctggggtc

SEQ ID NO: 12770 - DNA, 25 bp, Homo sapiens
ccataaacgggagctgctggggtca

SEQ ID NO: 12771 - DNA, 25 bp, Homo sapiens
cataaacgggagctgctggggtcac

SEQ ID NO: 12772 - DNA, 25 bp, Homo sapiens
ataaacgggagctgctggggtcacc

SEQ ID NO: 12773 - DNA, 25 bp, Homo sapiens
taaacgggagctgctggggtcaccc

SEQ ID NO: 12774 - DNA, 25 bp, Homo sapiens
aaacgggagctgctggggtcaccct

SEQ ID NO: 12775 - DNA, 25 bp, Homo sapiens
aacgggagctgctggggtcaccctc

SEQ ID NO: 12776 - DNA, 25 bp, Homo sapiens
acgggagctgctggggtcaccctct

SEQ ID NO: 12777 - DNA, 25 bp, Homo sapiens
cgggagctgctggggtcaccctctc

SEQ ID NO: 12778 - DNA, 25 bp, Homo sapiens
gggagctgctggggtcaccctctct

SEQ ID NO: 12779 - DNA, 25 bp, Homo sapiens
ggagctgctggggtcaccctctctg

SEQ ID NO: 12780 - DNA, 25 bp, Homo sapiens
gagctgctggggtcaccctctctgg

SEQ ID NO: 12781 - DNA, 25 bp, Homo sapiens
agctgctggggtcaccctctctggg

SEQ ID NO: 12782 - DNA, 25 bp, Homo sapiens
gctgctggggtcaccctctctgggg

SEQ ID NO: 12783 - DNA, 25 bp, Homo sapiens
ctgctggggtcaccctctctggggg

SEQ ID NO: 12784 - DNA, 25 bp, Homo sapiens
tgctggggtcaccctctctggggga

SEQ ID NO: 12785 - DNA, 25 bp, Homo sapiens
gctggggtcaccctctctgggggaa

SEQ ID NO: 12786 - DNA, 25 bp, Homo sapiens
ctggggtcaccctctctgggggaaa

SEQ ID NO: 12787 - DNA, 25 bp, Homo sapiens
tggggtcaccctctctgggggaaaa

SEQ ID NO: 12788 - DNA, 25 bp, Homo sapiens
ggggtcaccctctctgggggaaaat

SEQ ID NO: 12789 - DNA, 25 bp, Homo sapiens
gggtcaccctctctgggggaaaatt

SEQ ID NO: 12790 - DNA, 25 bp, Homo sapiens
ggtcaccctctctgggggaaaattg

SEQ ID NO: 12791 - DNA, 25 bp, Homo sapiens
gtcaccctctctgggggaaaattgc

SEQ ID NO: 12792 - DNA, 25 bp, Homo sapiens
tcaccctctctgggggaaaattgcg

SEQ ID NO: 12793 - DNA, 25 bp, Homo sapiens
caccctctctgggggaaaattgcgt

SEQ ID NO: 12794 - DNA, 25 bp, Homo sapiens
accctctctgggggaaaattgcgtt

SEQ ID NO: 12795 - DNA, 25 bp, Homo sapiens
ccctctctgggggaaaattgcgttg

SEQ ID NO: 12796 - DNA, 25 bp, Homo sapiens
cctctctgggggaaaattgcgttgc

SEQ ID NO: 12797 - DNA, 25 bp, Homo sapiens
ctctctgggggaaaattgcgttgct

SEQ ID NO: 12798 - DNA, 25 bp, Homo sapiens
tctctgggggaaaattgcgttgctg

SEQ ID NO: 12799 - DNA, 25 bp, Homo sapiens
ctctgggggaaaattgcgttgctgg

SEQ ID NO: 12800 - DNA, 25 bp, Homo sapiens
tctgggggaaaattgcgttgctggc

SEQ ID NO: 12801 - DNA, 25 bp, Homo sapiens
ctgggggaaaattgcgttgctggct

SEQ ID NO: 12802 - DNA, 25 bp, Homo sapiens
tgggggaaaattgcgttgctggctt

SEQ ID NO: 12803 - DNA, 25 bp, Homo sapiens
gggggaaaattgcgttgctggcttg

SEQ ID NO: 12804 - DNA, 25 bp, Homo sapiens
ggggaaaattgcgttgctggcttga

SEQ ID NO: 12805 - DNA, 25 bp, Homo sapiens
gggaaaattgcgttgctggcttgaa

SEQ ID NO: 12806 - DNA, 25 bp, Homo sapiens
ggaaaattgcgttgctggcttgaag

SEQ ID NO: 12807 - DNA, 25 bp, Homo sapiens
gaaaattgcgttgctggcttgaagg

SEQ ID NO: 12808 - DNA, 25 bp, Homo sapiens
aaaattgcgttgctggcttgaagga

SEQ ID NO: 12809 - DNA, 25 bp, Homo sapiens
aaattgcgttgctggcttgaaggag

SEQ ID NO: 12810 - DNA, 25 bp, Homo sapiens
aattgcgttgctggcttgaaggaga

SEQ ID NO: 12811 - DNA, 25 bp, Homo sapiens
attgcgttgctggcttgaaggagag

SEQ ID NO: 12812 - DNA, 25 bp, Homo sapiens
ttgcgttgctggcttgaaggagagg

SEQ ID NO: 12813 - DNA, 25 bp, Homo sapiens
tgcgttgctggcttgaaggagaggc

SEQ ID NO: 12814 - DNA, 25 bp, Homo sapiens
gcgttgctggcttgaaggagaggct

SEQ ID NO: 12815 - DNA, 25 bp, Homo sapiens
cgttgctggcttgaaggagaggctc

SEQ ID NO: 12816 - DNA, 25 bp, Homo sapiens
gttgctggcttgaaggagaggctct

SEQ ID NO: 12817 - DNA, 25 bp, Homo sapiens
ttgctggcttgaaggagaggctctg

SEQ ID NO: 12818 - DNA, 25 bp, Homo sapiens
tgctggcttgaaggagaggctctgg

SEQ ID NO: 12819 - DNA, 25 bp, Homo sapiens
gctggcttgaaggagaggctctgga

SEQ ID NO: 12820 - DNA, 25 bp, Homo sapiens
ctggcttgaaggagaggctctggaa

SEQ ID NO: 12821 - DNA, 25 bp, Homo sapiens
tggcttgaaggagaggctctggaag

SEQ ID NO: 12822 - DNA, 25 bp, Homo sapiens
ggcttgaaggagaggctctggaagt

SEQ ID NO: 12823 - DNA, 25 bp, Homo sapiens
gcttgaaggagaggctctggaagtt

SEQ ID NO: 12824 - DNA, 25 bp, Homo sapiens
cttgaaggagaggctctggaagttg

SEQ ID NO: 12825 - DNA, 25 bp, Homo sapiens
ttgaaggagaggctctggaagttgg

SEQ ID NO: 12826 - DNA, 25 bp, Homo sapiens
tgaaggagaggctctggaagttgga

SEQ ID NO: 12827 - DNA, 25 bp, Homo sapiens
gaaggagaggctctggaagttggaa

SEQ ID NO: 12828 - DNA, 25 bp, Homo sapiens
aaggagaggctctggaagttggaat

SEQ ID NO: 12829 - DNA, 25 bp, Homo sapiens
aggagaggctctggaagttggaatc

SEQ ID NO: 12830 - DNA, 25 bp, Homo sapiens
ggagaggctctggaagttggaatcc

SEQ ID NO: 12831 - DNA, 25 bp, Homo sapiens
gagaggctctggaagttggaatcca

SEQ ID NO: 12832 - DNA, 25 bp, Homo sapiens
agaggctctggaagttggaatccag

SEQ ID NO: 12833 - DNA, 25 bp, Homo sapiens
gaggctctggaagttggaatccagc

SEQ ID NO: 12834 - DNA, 25 bp, Homo sapiens
aggctctggaagttggaatccagcg

SEQ ID NO: 12835 - DNA, 25 bp, Homo sapiens
ggctctggaagttggaatccagcgc

SEQ ID NO: 12836 - DNA, 25 bp, Homo sapiens
gctctggaagttggaatccagcgcc

SEQ ID NO: 12837 - DNA, 25 bp, Homo sapiens
ctctggaagttggaatccagcgccc

SEQ ID NO: 12838 - DNA, 25 bp, Homo sapiens
tctggaagttggaatccagcgccct

SEQ ID NO: 12839 - DNA, 25 bp, Homo sapiens
ctggaagttggaatccagcgccctt

SEQ ID NO: 12840 - DNA, 25 bp, Homo sapiens
tggaagttggaatccagcgcccttg

SEQ ID NO: 12841 - DNA, 25 bp, Homo sapiens
ggaagttggaatccagcgcccttga

SEQ ID NO: 12842 - DNA, 25 bp, Homo sapiens
gaagttggaatccagcgcccttgag

SEQ ID NO: 12843 - DNA, 25 bp, Homo sapiens
aagttggaatccagcgcccttgagc

SEQ ID NO: 12844 - DNA, 25 bp, Homo sapiens
agttggaatccagcgcccttgagca

SEQ ID NO: 12845 - DNA, 25 bp, Homo sapiens
gttggaatccagcgcccttgagcaa

SEQ ID NO: 12846 - DNA, 25 bp, Homo sapiens
ttggaatccagcgcccttgagcaac

SEQ ID NO: 12847 - DNA, 25 bp, Homo sapiens
tggaatccagcgcccttgagcaaca

SEQ ID NO: 12848 - DNA, 25 bp, Homo sapiens
ggaatccagcgcccttgagcaacag

SEQ ID NO: 12849 - DNA, 25 bp, Homo sapiens
gaatccagcgcccttgagcaacaga

SEQ ID NO: 12850 - DNA, 25 bp, Homo sapiens
aatccagcgcccttgagcaacagaa

SEQ ID NO: 12851 - DNA, 25 bp, Homo sapiens
atccagcgcccttgagcaacagaaa

SEQ ID NO: 12852 - DNA, 25 bp, Homo sapiens
tccagcgcccttgagcaacagaaaa

SEQ ID NO: 12853 - DNA, 25 bp, Homo sapiens
ccagcgcccttgagcaacagaaaat

SEQ ID NO: 12854 - DNA, 25 bp, Homo sapiens
cagcgcccttgagcaacagaaaatc

SEQ ID NO: 12855 - DNA, 25 bp, Homo sapiens
agcgcccttgagcaacagaaaatcc

SEQ ID NO: 12856 - DNA, 25 bp, Homo sapiens
gcgcccttgagcaacagaaaatcca

SEQ ID NO: 12857 - DNA, 25 bp, Homo sapiens
cgcccttgagcaacagaaaatccag

SEQ ID NO: 12858 - DNA, 25 bp, Homo sapiens
gcccttgagcaacagaaaatccaga

SEQ ID NO: 12859 - DNA, 25 bp, Homo sapiens
cccttgagcaacagaaaatccagag

SEQ ID NO: 12860 - DNA, 25 bp, Homo sapiens
ccttgagcaacagaaaatccagagc

SEQ ID NO: 12861 - DNA, 25 bp, Homo sapiens
cttgagcaacagaaaatccagagcc

SEQ ID NO: 12862 - DNA, 25 bp, Homo sapiens
ttgagcaacagaaaatccagagcca

SEQ ID NO: 12863 - DNA, 25 bp, Homo sapiens
tgagcaacagaaaatccagagccag

SEQ ID NO: 12864 - DNA, 25 bp, Homo sapiens
gagcaacagaaaatccagagccagc

SEQ ID NO: 12865 - DNA, 25 bp, Homo sapiens
agcaacagaaaatccagagccagca

SEQ ID NO: 12866 - DNA, 25 bp, Homo sapiens
gcaacagaaaatccagagccagcag

SEQ ID NO: 12867 - DNA, 25 bp, Homo sapiens
caacagaaaatccagagccagcagg

SEQ ID NO: 12868 - DNA, 25 bp, Homo sapiens
aacagaaaatccagagccagcagga

SEQ ID NO: 12869 - DNA, 25 bp, Homo sapiens
acagaaaatccagagccagcaggaa

SEQ ID NO: 12870 - DNA, 25 bp, Homo sapiens
cagaaaatccagagccagcaggaaa

SEQ ID NO: 12871 - DNA, 25 bp, Homo sapiens
agaaaatccagagccagcaggaaaa

SEQ ID NO: 12872 - DNA, 25 bp, Homo sapiens
gaaaatccagagccagcaggaaaac

SEQ ID NO: 12873 - DNA, 25 bp, Homo sapiens
aaaatccagagccagcaggaaaaca

SEQ ID NO: 12874 - DNA, 25 bp, Homo sapiens
aaatccagagccagcaggaaaacac

SEQ ID NO: 12875 - DNA, 25 bp, Homo sapiens
aatccagagccagcaggaaaacacc

SEQ ID NO: 12876 - DNA, 25 bp, Homo sapiens
atccagagccagcaggaaaacacca

SEQ ID NO: 12877 - DNA, 25 bp, Homo sapiens
tccagagccagcaggaaaacaccat

SEQ ID NO: 12878 - DNA, 25 bp, Homo sapiens
ccagagccagcaggaaaacaccatc

SEQ ID NO: 12879 - DNA, 25 bp, Homo sapiens
cagagccagcaggaaaacaccatca

SEQ ID NO: 12880 - DNA, 25 bp, Homo sapiens
agagccagcaggaaaacaccatcaa

SEQ ID NO: 12881 - DNA, 25 bp, Homo sapiens
gagccagcaggaaaacaccatcaag

SEQ ID NO: 12882 - DNA, 25 bp, Homo sapiens
agccagcaggaaaacaccatcaagc

SEQ ID NO: 12883 - DNA, 25 bp, Homo sapiens
gccagcaggaaaacaccatcaagca

SEQ ID NO: 12884 - DNA, 25 bp, Homo sapiens
ccagcaggaaaacaccatcaagcag

SEQ ID NO: 12885 - DNA, 25 bp, Homo sapiens
cagcaggaaaacaccatcaagcagc

SEQ ID NO: 12886 - DNA, 25 bp, Homo sapiens
agcaggaaaacaccatcaagcagct

SEQ ID NO: 12887 - DNA, 25 bp, Homo sapiens
gcaggaaaacaccatcaagcagctg

SEQ ID NO: 12888 - DNA, 25 bp, Homo sapiens
caggaaaacaccatcaagcagctgg

SEQ ID NO: 12889 - DNA, 25 bp, Homo sapiens
aggaaaacaccatcaagcagctgga

SEQ ID NO: 12890 - DNA, 25 bp, Homo sapiens
ggaaaacaccatcaagcagctggag

SEQ ID NO: 12891 - DNA, 25 bp, Homo sapiens
gaaaacaccatcaagcagctggagc

SEQ ID NO: 12892 - DNA, 25 bp, Homo sapiens
aaaacaccatcaagcagctggagca

SEQ ID NO: 12893 - DNA, 25 bp, Homo sapiens
aaacaccatcaagcagctggagcag

SEQ ID NO: 12894 - DNA, 25 bp, Homo sapiens
aacaccatcaagcagctggagcagc

SEQ ID NO: 12895 - DNA, 25 bp, Homo sapiens
acaccatcaagcagctggagcagct

SEQ ID NO: 12896 - DNA, 25 bp, Homo sapiens
caccatcaagcagctggagcagctc

SEQ ID NO: 12897 - DNA, 25 bp, Homo sapiens
accatcaagcagctggagcagctcc

SEQ ID NO: 12898 - DNA, 25 bp, Homo sapiens
ccatcaagcagctggagcagctccg

SEQ ID NO: 12899 - DNA, 25 bp, Homo sapiens
catcaagcagctggagcagctccgc

SEQ ID NO: 12900 - DNA, 25 bp, Homo sapiens
atcaagcagctggagcagctccgcc

SEQ ID NO: 12901 - DNA, 25 bp, Homo sapiens
tcaagcagctggagcagctccgcca

SEQ ID NO: 12902 - DNA, 25 bp, Homo sapiens
caagcagctggagcagctccgccag

SEQ ID NO: 12903 - DNA, 25 bp, Homo sapiens
aagcagctggagcagctccgccagc

SEQ ID NO: 12904 - DNA, 25 bp, Homo sapiens
agcagctggagcagctccgccagcg

SEQ ID NO: 12905 - DNA, 25 bp, Homo sapiens
gcagctggagcagctccgccagcgg

SEQ ID NO: 12906 - DNA, 25 bp, Homo sapiens
cagctggagcagctccgccagcggt

SEQ ID NO: 12907 - DNA, 25 bp, Homo sapiens
agctggagcagctccgccagcggtt

SEQ ID NO: 12908 - DNA, 25 bp, Homo sapiens
gctggagcagctccgccagcggttt

SEQ ID NO: 12909 - DNA, 25 bp, Homo sapiens
ctggagcagctccgccagcggtttg

SEQ ID NO: 12910 - DNA, 25 bp, Homo sapiens
tggagcagctccgccagcggtttga

SEQ ID NO: 12911 - DNA, 25 bp, Homo sapiens
ggagcagctccgccagcggtttgag

SEQ ID NO: 12912 - DNA, 25 bp, Homo sapiens
gagcagctccgccagcggtttgagc

SEQ ID NO: 12913 - DNA, 25 bp, Homo sapiens
agcagctccgccagcggtttgagct

SEQ ID NO: 12914 - DNA, 25 bp, Homo sapiens
gcagctccgccagcggtttgagctg

SEQ ID NO: 12915 - DNA, 25 bp, Homo sapiens
cagctccgccagcggtttgagctgg

SEQ ID NO: 12916 - DNA, 25 bp, Homo sapiens
agctccgccagcggtttgagctgga

SEQ ID NO: 12917 - DNA, 25 bp, Homo sapiens
gctccgccagcggtttgagctggag

SEQ ID NO: 12918 - DNA, 25 bp, Homo sapiens
ctccgccagcggtttgagctggaga

SEQ ID NO: 12919 - DNA, 25 bp, Homo sapiens
tccgccagcggtttgagctggagat

SEQ ID NO: 12920 - DNA, 25 bp, Homo sapiens
ccgccagcggtttgagctggagatc

SEQ ID NO: 12921 - DNA, 25 bp, Homo sapiens
cgccagcggtttgagctggagatcg

SEQ ID NO: 12922 - DNA, 25 bp, Homo sapiens
gccagcggtttgagctggagatcga

SEQ ID NO: 12923 - DNA, 25 bp, Homo sapiens
ccagcggtttgagctggagatcgag

SEQ ID NO: 12924 - DNA, 25 bp, Homo sapiens
cagcggtttgagctggagatcgagc

SEQ ID NO: 12925 - DNA, 25 bp, Homo sapiens
agcggtttgagctggagatcgagcg

SEQ ID NO: 12926 - DNA, 25 bp, Homo sapiens
gcggtttgagctggagatcgagcgg

SEQ ID NO: 12927 - DNA, 25 bp, Homo sapiens
cggtttgagctggagatcgagcgga

SEQ ID NO: 12928 - DNA, 25 bp, Homo sapiens
ggtttgagctggagatcgagcggat

SEQ ID NO: 12929 - DNA, 25 bp, Homo sapiens
gtttgagctggagatcgagcggatg

SEQ ID NO: 12930 - DNA, 25 bp, Homo sapiens
tttgagctggagatcgagcggatga

SEQ ID NO: 12931 - DNA, 25 bp, Homo sapiens
ttgagctggagatcgagcggatgaa

SEQ ID NO: 12932 - DNA, 25 bp, Homo sapiens
tgagctggagatcgagcggatgaag

SEQ ID NO: 12933 - DNA, 25 bp, Homo sapiens
gagctggagatcgagcggatgaagc

SEQ ID NO: 12934 - DNA, 25 bp, Homo sapiens
agctggagatcgagcggatgaagca

SEQ ID NO: 12935 - DNA, 25 bp, Homo sapiens
gctggagatcgagcggatgaagcag

SEQ ID NO: 12936 - DNA, 25 bp, Homo sapiens
ctggagatcgagcggatgaagcaga

SEQ ID NO: 12937 - DNA, 25 bp, Homo sapiens
tggagatcgagcggatgaagcagat

SEQ ID NO: 12938 - DNA, 25 bp, Homo sapiens
ggagatcgagcggatgaagcagatg

SEQ ID NO: 12939 - DNA, 25 bp, Homo sapiens
gagatcgagcggatgaagcagatgc

SEQ ID NO: 12940 - DNA, 25 bp, Homo sapiens
agatcgagcggatgaagcagatgca

SEQ ID NO: 12941 - DNA, 25 bp, Homo sapiens
gatcgagcggatgaagcagatgcac

SEQ ID NO: 12942 - DNA, 25 bp, Homo sapiens
atcgagcggatgaagcagatgcacc

SEQ ID NO: 12943 - DNA, 25 bp, Homo sapiens
tcgagcggatgaagcagatgcacca

SEQ ID NO: 12944 - DNA, 25 bp, Homo sapiens
cgagcggatgaagcagatgcaccag

SEQ ID NO: 12945 - DNA, 25 bp, Homo sapiens
gagcggatgaagcagatgcaccaga

SEQ ID NO: 12946 - DNA, 25 bp, Homo sapiens
agcggatgaagcagatgcaccagaa

SEQ ID NO: 12947 - DNA, 25 bp, Homo sapiens
gcggatgaagcagatgcaccagaag

SEQ ID NO: 12948 - DNA, 25 bp, Homo sapiens
cggatgaagcagatgcaccagaagg

SEQ ID NO: 12949 - DNA, 25 bp, Homo sapiens
ggatgaagcagatgcaccagaagga

SEQ ID NO: 12950 - DNA, 25 bp, Homo sapiens
gatgaagcagatgcaccagaaggac

SEQ ID NO: 12951 - DNA, 25 bp, Homo sapiens
atgaagcagatgcaccagaaggacc

SEQ ID NO: 12952 - DNA, 25 bp, Homo sapiens
tgaagcagatgcaccagaaggaccg

SEQ ID NO: 12953 - DNA, 25 bp, Homo sapiens
gaagcagatgcaccagaaggaccgt

SEQ ID NO: 12954 - DNA, 25 bp, Homo sapiens
aagcagatgcaccagaaggaccgtg

SEQ ID NO: 12955 - DNA, 25 bp, Homo sapiens
agcagatgcaccagaaggaccgtga

SEQ ID NO: 12956 - DNA, 25 bp, Homo sapiens
gcagatgcaccagaaggaccgtgag

SEQ ID NO: 12957 - DNA, 25 bp, Homo sapiens
cagatgcaccagaaggaccgtgagg

SEQ ID NO: 12958 - DNA, 25 bp, Homo sapiens
agatgcaccagaaggaccgtgagga

SEQ ID NO: 12959 - DNA, 25 bp, Homo sapiens
gatgcaccagaaggaccgtgaggac

SEQ ID NO: 12960 - DNA, 25 bp, Homo sapiens
atgcaccagaaggaccgtgaggacc

SEQ ID NO: 12961 - DNA, 25 bp, Homo sapiens
tgcaccagaaggaccgtgaggacca

SEQ ID NO: 12962 - DNA, 25 bp, Homo sapiens
gcaccagaaggaccgtgaggaccag

SEQ ID NO: 12963 - DNA, 25 bp, Homo sapiens
caccagaaggaccgtgaggaccagg

SEQ ID NO: 12964 - DNA, 25 bp, Homo sapiens
accagaaggaccgtgaggaccagga

SEQ ID NO: 12965 - DNA, 25 bp, Homo sapiens
ccagaaggaccgtgaggaccaggag

SEQ ID NO: 12966 - DNA, 25 bp, Homo sapiens
cagaaggaccgtgaggaccaggagg

SEQ ID NO: 12967 - DNA, 25 bp, Homo sapiens
agaaggaccgtgaggaccaggagga

SEQ ID NO: 12968 - DNA, 25 bp, Homo sapiens
gaaggaccgtgaggaccaggaggag

SEQ ID NO: 12969 - DNA, 25 bp, Homo sapiens
aaggaccgtgaggaccaggaggagg

SEQ ID NO: 12970 - DNA, 25 bp, Homo sapiens
aggaccgtgaggaccaggaggagga

SEQ ID NO: 12971 - DNA, 25 bp, Homo sapiens
ggaccgtgaggaccaggaggaggaa

SEQ ID NO: 12972 - DNA, 25 bp, Homo sapiens
gaccgtgaggaccaggaggaggaac

SEQ ID NO: 12973 - DNA, 25 bp, Homo sapiens
accgtgaggaccaggaggaggaact

SEQ ID NO: 12974 - DNA, 25 bp, Homo sapiens
ccgtgaggaccaggaggaggaactg

SEQ ID NO: 12975 - DNA, 25 bp, Homo sapiens
cgtgaggaccaggaggaggaactgg

SEQ ID NO: 12976 - DNA, 25 bp, Homo sapiens
gtgaggaccaggaggaggaactgga

SEQ ID NO: 12977 - DNA, 25 bp, Homo sapiens
tgaggaccaggaggaggaactggag

SEQ ID NO: 12978 - DNA, 25 bp, Homo sapiens
gaggaccaggaggaggaactggagg

SEQ ID NO: 12979 - DNA, 25 bp, Homo sapiens
aggaccaggaggaggaactggagga

SEQ ID NO: 12980 - DNA, 25 bp, Homo sapiens
ggaccaggaggaggaactggaggat

SEQ ID NO: 12981 - DNA, 25 bp, Homo sapiens
gaccaggaggaggaactggaggatg

SEQ ID NO: 12982 - DNA, 25 bp, Homo sapiens
accaggaggaggaactggaggatgt

SEQ ID NO: 12983 - DNA, 25 bp, Homo sapiens
ccaggaggaggaactggaggatgtc

SEQ ID NO: 12984 - DNA, 25 bp, Homo sapiens
caggaggaggaactggaggatgtcc

SEQ ID NO: 12985 - DNA, 25 bp, Homo sapiens
aggaggaggaactggaggatgtccg

SEQ ID NO: 12986 - DNA, 25 bp, Homo sapiens
ggaggaggaactggaggatgtccgt

SEQ ID NO: 12987 - DNA, 25 bp, Homo sapiens
gaggaggaactggaggatgtccgtc

SEQ ID NO: 12988 - DNA, 25 bp, Homo sapiens
aggaggaactggaggatgtccgtca

SEQ ID NO: 12989 - DNA, 25 bp, Homo sapiens
ggaggaactggaggatgtccgtcag

SEQ ID NO: 12990 - DNA, 25 bp, Homo sapiens
gaggaactggaggatgtccgtcagt

SEQ ID NO: 12991 - DNA, 25 bp, Homo sapiens
aggaactggaggatgtccgtcagtc

SEQ ID NO: 12992 - DNA, 25 bp, Homo sapiens
ggaactggaggatgtccgtcagtcc

SEQ ID NO: 12993 - DNA, 25 bp, Homo sapiens
gaactggaggatgtccgtcagtcct

SEQ ID NO: 12994 - DNA, 25 bp, Homo sapiens
aactggaggatgtccgtcagtcctg

SEQ ID NO: 12995 - DNA, 25 bp, Homo sapiens
actggaggatgtccgtcagtcctgc

SEQ ID NO: 12996 - DNA, 25 bp, Homo sapiens
ctggaggatgtccgtcagtcctgcc

SEQ ID NO: 12997 - DNA, 25 bp, Homo sapiens
tggaggatgtccgtcagtcctgcca

SEQ ID NO: 12998 - DNA, 25 bp, Homo sapiens
ggaggatgtccgtcagtcctgccag

SEQ ID NO: 12999 - DNA, 25 bp, Homo sapiens
gaggatgtccgtcagtcctgccaga

SEQ ID NO: 13000 - DNA, 25 bp, Homo sapiens
aggatgtccgtcagtcctgccagaa

SEQ ID NO: 13001 - DNA, 25 bp, Homo sapiens
ggatgtccgtcagtcctgccagaag

SEQ ID NO: 13002 - DNA, 25 bp, Homo sapiens
gatgtccgtcagtcctgccagaagc

SEQ ID NO: 13003 - DNA, 25 bp, Homo sapiens
atgtccgtcagtcctgccagaagcg

SEQ ID NO: 13004 - DNA, 25 bp, Homo sapiens
tgtccgtcagtcctgccagaagcgg

SEQ ID NO: 13005 - DNA, 25 bp, Homo sapiens
gtccgtcagtcctgccagaagcggc

SEQ ID NO: 13006 - DNA, 25 bp, Homo sapiens
tccgtcagtcctgccagaagcggct

SEQ ID NO: 13007 - DNA, 25 bp, Homo sapiens
ccgtcagtcctgccagaagcggctt

SEQ ID NO: 13008 - DNA, 25 bp, Homo sapiens
cgtcagtcctgccagaagcggcttc

SEQ ID NO: 13009 - DNA, 25 bp, Homo sapiens
gtcagtcctgccagaagcggcttca

SEQ ID NO: 13010 - DNA, 25 bp, Homo sapiens
tcagtcctgccagaagcggcttcat

SEQ ID NO: 13011 - DNA, 25 bp, Homo sapiens
cagtcctgccagaagcggcttcatc

SEQ ID NO: 13012 - DNA, 25 bp, Homo sapiens
agtcctgccagaagcggcttcatca

SEQ ID NO: 13013 - DNA, 25 bp, Homo sapiens
gtcctgccagaagcggcttcatcag

SEQ ID NO: 13014 - DNA, 25 bp, Homo sapiens
tcctgccagaagcggcttcatcagc

SEQ ID NO: 13015 - DNA, 25 bp, Homo sapiens
cctgccagaagcggcttcatcagct

SEQ ID NO: 13016 - DNA, 25 bp, Homo sapiens
ctgccagaagcggcttcatcagctg

SEQ ID NO: 13017 - DNA, 25 bp, Homo sapiens
tgccagaagcggcttcatcagctgg

SEQ ID NO: 13018 - DNA, 25 bp, Homo sapiens
gccagaagcggcttcatcagctgga

SEQ ID NO: 13019 - DNA, 25 bp, Homo sapiens
ccagaagcggcttcatcagctggaa

SEQ ID NO: 13020 - DNA, 25 bp, Homo sapiens
cagaagcggcttcatcagctggaaa

SEQ ID NO: 13021 - DNA, 25 bp, Homo sapiens
agaagcggcttcatcagctggaaat

SEQ ID NO: 13022 - DNA, 25 bp, Homo sapiens
gaagcggcttcatcagctggaaatg

SEQ ID NO: 13023 - DNA, 25 bp, Homo sapiens
aagcggcttcatcagctggaaatgc

SEQ ID NO: 13024 - DNA, 25 bp, Homo sapiens
agcggcttcatcagctggaaatgca

SEQ ID NO: 13025 - DNA, 25 bp, Homo sapiens
gcggcttcatcagctggaaatgcag

SEQ ID NO: 13026 - DNA, 25 bp, Homo sapiens
cggcttcatcagctggaaatgcagc

SEQ ID NO: 13027 - DNA, 25 bp, Homo sapiens
ggcttcatcagctggaaatgcagct

SEQ ID NO: 13028 - DNA, 25 bp, Homo sapiens
gcttcatcagctggaaatgcagctg

SEQ ID NO: 13029 - DNA, 25 bp, Homo sapiens
cttcatcagctggaaatgcagctgg

SEQ ID NO: 13030 - DNA, 25 bp, Homo sapiens
ttcatcagctggaaatgcagctgga

SEQ ID NO: 13031 - DNA, 25 bp, Homo sapiens
tcatcagctggaaatgcagctggag

SEQ ID NO: 13032 - DNA, 25 bp, Homo sapiens
catcagctggaaatgcagctggagc

SEQ ID NO: 13033 - DNA, 25 bp, Homo sapiens
atcagctggaaatgcagctggagca

SEQ ID NO: 13034 - DNA, 25 bp, Homo sapiens
tcagctggaaatgcagctggagcaa

SEQ ID NO: 13035 - DNA, 25 bp, Homo sapiens
cagctggaaatgcagctggagcaag

SEQ ID NO: 13036 - DNA, 25 bp, Homo sapiens
agctggaaatgcagctggagcaaga

SEQ ID NO: 13037 - DNA, 25 bp, Homo sapiens
gctggaaatgcagctggagcaagag

SEQ ID NO: 13038 - DNA, 25 bp, Homo sapiens
ctggaaatgcagctggagcaagagt

SEQ ID NO: 13039 - DNA, 25 bp, Homo sapiens
tggaaatgcagctggagcaagagta

SEQ ID NO: 13040 - DNA, 25 bp, Homo sapiens
ggaaatgcagctggagcaagagtat

SEQ ID NO: 13041 - DNA, 25 bp, Homo sapiens
gaaatgcagctggagcaagagtatg

SEQ ID NO: 13042 - DNA, 25 bp, Homo sapiens
aaatgcagctggagcaagagtatga

SEQ ID NO: 13043 - DNA, 25 bp, Homo sapiens
aatgcagctggagcaagagtatgaa

SEQ ID NO: 13044 - DNA, 25 bp, Homo sapiens
atgcagctggagcaagagtatgaag

SEQ ID NO: 13045 - DNA, 25 bp, Homo sapiens
tgcagctggagcaagagtatgaaga

SEQ ID NO: 13046 - DNA, 25 bp, Homo sapiens
gcagctggagcaagagtatgaagag

SEQ ID NO: 13047 - DNA, 25 bp, Homo sapiens
cagctggagcaagagtatgaagaga

SEQ ID NO: 13048 - DNA, 25 bp, Homo sapiens
agctggagcaagagtatgaagagaa

SEQ ID NO: 13049 - DNA, 25 bp, Homo sapiens
gctggagcaagagtatgaagagaag

SEQ ID NO: 13050 - DNA, 25 bp, Homo sapiens
ctggagcaagagtatgaagagaagc

SEQ ID NO: 13051 - DNA, 25 bp, Homo sapiens
tggagcaagagtatgaagagaagca

SEQ ID NO: 13052 - DNA, 25 bp, Homo sapiens
ggagcaagagtatgaagagaagcag

SEQ ID NO: 13053 - DNA, 25 bp, Homo sapiens
gagcaagagtatgaagagaagcaga

SEQ ID NO: 13054 - DNA, 25 bp, Homo sapiens
agcaagagtatgaagagaagcagat

SEQ ID NO: 13055 - DNA, 25 bp, Homo sapiens
gcaagagtatgaagagaagcagatg

SEQ ID NO: 13056 - DNA, 25 bp, Homo sapiens
caagagtatgaagagaagcagatgg

SEQ ID NO: 13057 - DNA, 25 bp, Homo sapiens
aagagtatgaagagaagcagatggt

SEQ ID NO: 13058 - DNA, 25 bp, Homo sapiens
agagtatgaagagaagcagatggtc

SEQ ID NO: 13059 - DNA, 25 bp, Homo sapiens
gagtatgaagagaagcagatggtcc

SEQ ID NO: 13060 - DNA, 25 bp, Homo sapiens
agtatgaagagaagcagatggtcct

SEQ ID NO: 13061 - DNA, 25 bp, Homo sapiens
gtatgaagagaagcagatggtcctc

SEQ ID NO: 13062 - DNA, 25 bp, Homo sapiens
tatgaagagaagcagatggtcctcc

SEQ ID NO: 13063 - DNA, 25 bp, Homo sapiens
atgaagagaagcagatggtcctcca

SEQ ID NO: 13064 - DNA, 25 bp, Homo sapiens
tgaagagaagcagatggtcctccat

SEQ ID NO: 13065 - DNA, 25 bp, Homo sapiens
gaagagaagcagatggtcctccatg

SEQ ID NO: 13066 - DNA, 25 bp, Homo sapiens
aagagaagcagatggtcctccatga

SEQ ID NO: 13067 - DNA, 25 bp, Homo sapiens
agagaagcagatggtcctccatgag

SEQ ID NO: 13068 - DNA, 25 bp, Homo sapiens
gagaagcagatggtcctccatgaga

SEQ ID NO: 13069 - DNA, 25 bp, Homo sapiens
agaagcagatggtcctccatgagaa

SEQ ID NO: 13070 - DNA, 25 bp, Homo sapiens
gaagcagatggtcctccatgagaag

SEQ ID NO: 13071 - DNA, 25 bp, Homo sapiens
aagcagatggtcctccatgagaagc

SEQ ID NO: 13072 - DNA, 25 bp, Homo sapiens
agcagatggtcctccatgagaagca

SEQ ID NO: 13073 - DNA, 25 bp, Homo sapiens
gcagatggtcctccatgagaagcaa

SEQ ID NO: 13074 - DNA, 25 bp, Homo sapiens
cagatggtcctccatgagaagcaag

SEQ ID NO: 13075 - DNA, 25 bp, Homo sapiens
agatggtcctccatgagaagcaaga

SEQ ID NO: 13076 - DNA, 25 bp, Homo sapiens
gatggtcctccatgagaagcaagat

SEQ ID NO: 13077 - DNA, 25 bp, Homo sapiens
atggtcctccatgagaagcaagatt

SEQ ID NO: 13078 - DNA, 25 bp, Homo sapiens
tggtcctccatgagaagcaagattt

SEQ ID NO: 13079 - DNA, 25 bp, Homo sapiens
ggtcctccatgagaagcaagatttg

SEQ ID NO: 13080 - DNA, 25 bp, Homo sapiens
gtcctccatgagaagcaagatttgg

SEQ ID NO: 13081 - DNA, 25 bp, Homo sapiens
tcctccatgagaagcaagatttgga

SEQ ID NO: 13082 - DNA, 25 bp, Homo sapiens
cctccatgagaagcaagatttggaa

SEQ ID NO: 13083 - DNA, 25 bp, Homo sapiens
ctccatgagaagcaagatttggaag

SEQ ID NO: 13084 - DNA, 25 bp, Homo sapiens
tccatgagaagcaagatttggaagg

SEQ ID NO: 13085 - DNA, 25 bp, Homo sapiens
ccatgagaagcaagatttggaaggc

SEQ ID NO: 13086 - DNA, 25 bp, Homo sapiens
catgagaagcaagatttggaaggct

SEQ ID NO: 13087 - DNA, 25 bp, Homo sapiens
atgagaagcaagatttggaaggctt

SEQ ID NO: 13088 - DNA, 25 bp, Homo sapiens
tgagaagcaagatttggaaggcttg

SEQ ID NO: 13089 - DNA, 25 bp, Homo sapiens
gagaagcaagatttggaaggcttga

SEQ ID NO: 13090 - DNA, 25 bp, Homo sapiens
agaagcaagatttggaaggcttgat

SEQ ID NO: 13091 - DNA, 25 bp, Homo sapiens
gaagcaagatttggaaggcttgatc

SEQ ID NO: 13092 - DNA, 25 bp, Homo sapiens
aagcaagatttggaaggcttgatcg

SEQ ID NO: 13093 - DNA, 25 bp, Homo sapiens
agcaagatttggaaggcttgatcgg

SEQ ID NO: 13094 - DNA, 25 bp, Homo sapiens
gcaagatttggaaggcttgatcgga

SEQ ID NO: 13095 - DNA, 25 bp, Homo sapiens
caagatttggaaggcttgatcggaa

SEQ ID NO: 13096 - DNA, 25 bp, Homo sapiens
aagatttggaaggcttgatcggaac

SEQ ID NO: 13097 - DNA, 25 bp, Homo sapiens
agatttggaaggcttgatcggaacc

SEQ ID NO: 13098 - DNA, 25 bp, Homo sapiens
gatttggaaggcttgatcggaaccc

SEQ ID NO: 13099 - DNA, 25 bp, Homo sapiens
atttggaaggcttgatcggaaccct

SEQ ID NO: 13100 - DNA, 25 bp, Homo sapiens
tttggaaggcttgatcggaaccctc

SEQ ID NO: 13101 - DNA, 25 bp, Homo sapiens
ttggaaggcttgatcggaaccctct

SEQ ID NO: 13102 - DNA, 25 bp, Homo sapiens
tggaaggcttgatcggaaccctctg

SEQ ID NO: 13103 - DNA, 25 bp, Homo sapiens
ggaaggcttgatcggaaccctctgt

SEQ ID NO: 13104 - DNA, 25 bp, Homo sapiens
gaaggcttgatcggaaccctctgtg

SEQ ID NO: 13105 - DNA, 25 bp, Homo sapiens
aaggcttgatcggaaccctctgtga

SEQ ID NO: 13106 - DNA, 25 bp, Homo sapiens
aggcttgatcggaaccctctgtgac

SEQ ID NO: 13107 - DNA, 25 bp, Homo sapiens
ggcttgatcggaaccctctgtgacc

SEQ ID NO: 13108 - DNA, 25 bp, Homo sapiens
gcttgatcggaaccctctgtgacca

SEQ ID NO: 13109 - DNA, 25 bp, Homo sapiens
cttgatcggaaccctctgtgaccag

SEQ ID NO: 13110 - DNA, 25 bp, Homo sapiens
ttgatcggaaccctctgtgaccaga

SEQ ID NO: 13111 - DNA, 25 bp, Homo sapiens
tgatcggaaccctctgtgaccagat

SEQ ID NO: 13112 - DNA, 25 bp, Homo sapiens
gatcggaaccctctgtgaccagatt

SEQ ID NO: 13113 - DNA, 25 bp, Homo sapiens
atcggaaccctctgtgaccagattg

SEQ ID NO: 13114 - DNA, 25 bp, Homo sapiens
tcggaaccctctgtgaccagattgg

SEQ ID NO: 13115 - DNA, 25 bp, Homo sapiens
cggaaccctctgtgaccagattggc

SEQ ID NO: 13116 - DNA, 25 bp, Homo sapiens
ggaaccctctgtgaccagattggcc

SEQ ID NO: 13117 - DNA, 25 bp, Homo sapiens
gaaccctctgtgaccagattggcca

SEQ ID NO: 13118 - DNA, 25 bp, Homo sapiens
aaccctctgtgaccagattggccat

SEQ ID NO: 13119 - DNA, 25 bp, Homo sapiens
accctctgtgaccagattggccatc

SEQ ID NO: 13120 - DNA, 25 bp, Homo sapiens
ccctctgtgaccagattggccatcg

SEQ ID NO: 13121 - DNA, 25 bp, Homo sapiens
cctctgtgaccagattggccatcgg

SEQ ID NO: 13122 - DNA, 25 bp, Homo sapiens
ctctgtgaccagattggccatcggg

SEQ ID NO: 13123 - DNA, 25 bp, Homo sapiens
tctgtgaccagattggccatcggga

SEQ ID NO: 13124 - DNA, 25 bp, Homo sapiens
ctgtgaccagattggccatcgggac

SEQ ID NO: 13125 - DNA, 25 bp, Homo sapiens
tgtgaccagattggccatcgggact

SEQ ID NO: 13126 - DNA, 25 bp, Homo sapiens
gtgaccagattggccatcgggactt

SEQ ID NO: 13127 - DNA, 25 bp, Homo sapiens
tgaccagattggccatcgggacttt

SEQ ID NO: 13128 - DNA, 25 bp, Homo sapiens
gaccagattggccatcgggactttg

SEQ ID NO: 13129 - DNA, 25 bp, Homo sapiens
accagattggccatcgggactttga

SEQ ID NO: 13130 - DNA, 25 bp, Homo sapiens
ccagattggccatcgggactttgat

SEQ ID NO: 13131 - DNA, 25 bp, Homo sapiens
cagattggccatcgggactttgatg

SEQ ID NO: 13132 - DNA, 25 bp, Homo sapiens
agattggccatcgggactttgatgt

SEQ ID NO: 13133 - DNA, 25 bp, Homo sapiens
gattggccatcgggactttgatgtg

SEQ ID NO: 13134 - DNA, 25 bp, Homo sapiens
attggccatcgggactttgatgtgg

SEQ ID NO: 13135 - DNA, 25 bp, Homo sapiens
ttggccatcgggactttgatgtgga

SEQ ID NO: 13136 - DNA, 25 bp, Homo sapiens
tggccatcgggactttgatgtggag

SEQ ID NO: 13137 - DNA, 25 bp, Homo sapiens
ggccatcgggactttgatgtggaga

SEQ ID NO: 13138 - DNA, 25 bp, Homo sapiens
gccatcgggactttgatgtggagaa

SEQ ID NO: 13139 - DNA, 25 bp, Homo sapiens
ccatcgggactttgatgtggagaag

SEQ ID NO: 13140 - DNA, 25 bp, Homo sapiens
catcgggactttgatgtggagaagc

SEQ ID NO: 13141 - DNA, 25 bp, Homo sapiens
atcgggactttgatgtggagaagcg

SEQ ID NO: 13142 - DNA, 25 bp, Homo sapiens
tcgggactttgatgtggagaagcga

SEQ ID NO: 13143 - DNA, 25 bp, Homo sapiens
cgggactttgatgtggagaagcgac

SEQ ID NO: 13144 - DNA, 25 bp, Homo sapiens
gggactttgatgtggagaagcgact

SEQ ID NO: 13145 - DNA, 25 bp, Homo sapiens
ggactttgatgtggagaagcgactt

SEQ ID NO: 13146 - DNA, 25 bp, Homo sapiens
gactttgatgtggagaagcgacttc

SEQ ID NO: 13147 - DNA, 25 bp, Homo sapiens
actttgatgtggagaagcgacttcg

SEQ ID NO: 13148 - DNA, 25 bp, Homo sapiens
ctttgatgtggagaagcgacttcgg

SEQ ID NO: 13149 - DNA, 25 bp, Homo sapiens
tttgatgtggagaagcgacttcgga

SEQ ID NO: 13150 - DNA, 25 bp, Homo sapiens
ttgatgtggagaagcgacttcggag

SEQ ID NO: 13151 - DNA, 25 bp, Homo sapiens
tgatgtggagaagcgacttcggaga

SEQ ID NO: 13152 - DNA, 25 bp, Homo sapiens
gatgtggagaagcgacttcggagag

SEQ ID NO: 13153 - DNA, 25 bp, Homo sapiens
atgtggagaagcgacttcggagaga

SEQ ID NO: 13154 - DNA, 25 bp, Homo sapiens
tgtggagaagcgacttcggagagac

SEQ ID NO: 13155 - DNA, 25 bp, Homo sapiens
gtggagaagcgacttcggagagacc

SEQ ID NO: 13156 - DNA, 25 bp, Homo sapiens
tggagaagcgacttcggagagacct

SEQ ID NO: 13157 - DNA, 25 bp, Homo sapiens
ggagaagcgacttcggagagacctc

SEQ ID NO: 13158 - DNA, 25 bp, Homo sapiens
gagaagcgacttcggagagacctca

SEQ ID NO: 13159 - DNA, 25 bp, Homo sapiens
agaagcgacttcggagagacctcag

SEQ ID NO: 13160 - DNA, 25 bp, Homo sapiens
gaagcgacttcggagagacctcagg

SEQ ID NO: 13161 - DNA, 25 bp, Homo sapiens
aagcgacttcggagagacctcagga

SEQ ID NO: 13162 - DNA, 25 bp, Homo sapiens
agcgacttcggagagacctcaggag

SEQ ID NO: 13163 - DNA, 25 bp, Homo sapiens
gcgacttcggagagacctcaggagg

SEQ ID NO: 13164 - DNA, 25 bp, Homo sapiens
cgacttcggagagacctcaggagga

SEQ ID NO: 13165 - DNA, 25 bp, Homo sapiens
gacttcggagagacctcaggaggac

SEQ ID NO: 13166 - DNA, 25 bp, Homo sapiens
acttcggagagacctcaggaggaca

SEQ ID NO: 13167 - DNA, 25 bp, Homo sapiens
cttcggagagacctcaggaggacac

SEQ ID NO: 13168 - DNA, 25 bp, Homo sapiens
ttcggagagacctcaggaggacaca

SEQ ID NO: 13169 - DNA, 25 bp, Homo sapiens
tcggagagacctcaggaggacacat

SEQ ID NO: 13170 - DNA, 25 bp, Homo sapiens
cggagagacctcaggaggacacatg

SEQ ID NO: 13171 - DNA, 25 bp, Homo sapiens
ggagagacctcaggaggacacatgc

SEQ ID NO: 13172 - DNA, 25 bp, Homo sapiens
gagagacctcaggaggacacatgca

SEQ ID NO: 13173 - DNA, 25 bp, Homo sapiens
agagacctcaggaggacacatgcac

SEQ ID NO: 13174 - DNA, 25 bp, Homo sapiens
gagacctcaggaggacacatgcact

SEQ ID NO: 13175 - DNA, 25 bp, Homo sapiens
agacctcaggaggacacatgcactg

SEQ ID NO: 13176 - DNA, 25 bp, Homo sapiens
gacctcaggaggacacatgcactgt

SEQ ID NO: 13177 - DNA, 25 bp, Homo sapiens
acctcaggaggacacatgcactgtt

SEQ ID NO: 13178 - DNA, 25 bp, Homo sapiens
cctcaggaggacacatgcactgttg

SEQ ID NO: 13179 - DNA, 25 bp, Homo sapiens
ctcaggaggacacatgcactgttgt

SEQ ID NO: 13180 - DNA, 25 bp, Homo sapiens
tcaggaggacacatgcactgttgtc

SEQ ID NO: 13181 - DNA, 25 bp, Homo sapiens
caggaggacacatgcactgttgtca

SEQ ID NO: 13182 - DNA, 25 bp, Homo sapiens
aggaggacacatgcactgttgtcag

SEQ ID NO: 13183 - DNA, 25 bp, Homo sapiens
ggaggacacatgcactgttgtcaga

SEQ ID NO: 13184 - DNA, 25 bp, Homo sapiens
gaggacacatgcactgttgtcagac

SEQ ID NO: 13185 - DNA, 25 bp, Homo sapiens
aggacacatgcactgttgtcagacg

SEQ ID NO: 13186 - DNA, 25 bp, Homo sapiens
ggacacatgcactgttgtcagacgt

SEQ ID NO: 13187 - DNA, 25 bp, Homo sapiens
gacacatgcactgttgtcagacgtg

SEQ ID NO: 13188 - DNA, 25 bp, Homo sapiens
acacatgcactgttgtcagacgtgc

SEQ ID NO: 13189 - DNA, 25 bp, Homo sapiens
cacatgcactgttgtcagacgtgca

SEQ ID NO: 13190 - DNA, 25 bp, Homo sapiens
acatgcactgttgtcagacgtgcag

SEQ ID NO: 13191 - DNA, 25 bp, Homo sapiens
catgcactgttgtcagacgtgcagc

SEQ ID NO: 13192 - DNA, 25 bp, Homo sapiens
atgcactgttgtcagacgtgcagct

SEQ ID NO: 13193 - DNA, 25 bp, Homo sapiens
tgcactgttgtcagacgtgcagctc

SEQ ID NO: 13194 - DNA, 25 bp, Homo sapiens
gcactgttgtcagacgtgcagctcc

SEQ ID NO: 13195 - DNA, 25 bp, Homo sapiens
cactgttgtcagacgtgcagctcct

SEQ ID NO: 13196 - DNA, 25 bp, Homo sapiens
actgttgtcagacgtgcagctcctt

SEQ ID NO: 13197 - DNA, 25 bp, Homo sapiens
ctgttgtcagacgtgcagctccttc

SEQ ID NO: 13198 - DNA, 25 bp, Homo sapiens
tgttgtcagacgtgcagctccttct

SEQ ID NO: 13199 - DNA, 25 bp, Homo sapiens
gttgtcagacgtgcagctccttctg

SEQ ID NO: 13200 - DNA, 25 bp, Homo sapiens
ttgtcagacgtgcagctccttctgg

SEQ ID NO: 13201 - DNA, 25 bp, Homo sapiens
tgtcagacgtgcagctccttctggg

SEQ ID NO: 13202 - DNA, 25 bp, Homo sapiens
gtcagacgtgcagctccttctgggc

SEQ ID NO: 13203 - DNA, 25 bp, Homo sapiens
tcagacgtgcagctccttctgggca

SEQ ID NO: 13204 - DNA, 25 bp, Homo sapiens
cagacgtgcagctccttctgggcac

SEQ ID NO: 13205 - DNA, 25 bp, Homo sapiens
agacgtgcagctccttctgggcacc

SEQ ID NO: 13206 - DNA, 25 bp, Homo sapiens
gacgtgcagctccttctgggcacca

SEQ ID NO: 13207 - DNA, 25 bp, Homo sapiens
acgtgcagctccttctgggcaccat

SEQ ID NO: 13208 - DNA, 25 bp, Homo sapiens
cgtgcagctccttctgggcaccatg

SEQ ID NO: 13209 - DNA, 25 bp, Homo sapiens
gtgcagctccttctgggcaccatgg

SEQ ID NO: 13210 - DNA, 25 bp, Homo sapiens
tgcagctccttctgggcaccatgga

SEQ ID NO: 13211 - DNA, 25 bp, Homo sapiens
gcagctccttctgggcaccatggag

SEQ ID NO: 13212 - DNA, 25 bp, Homo sapiens
cagctccttctgggcaccatggagg

SEQ ID NO: 13213 - DNA, 25 bp, Homo sapiens
agctccttctgggcaccatggagga

SEQ ID NO: 13214 - DNA, 25 bp, Homo sapiens
gctccttctgggcaccatggaggat

SEQ ID NO: 13215 - DNA, 25 bp, Homo sapiens
ctccttctgggcaccatggaggatg

SEQ ID NO: 13216 - DNA, 25 bp, Homo sapiens
tccttctgggcaccatggaggatgg

SEQ ID NO: 13217 - DNA, 25 bp, Homo sapiens
ccttctgggcaccatggaggatggc

SEQ ID NO: 13218 - DNA, 25 bp, Homo sapiens
cttctgggcaccatggaggatggca

SEQ ID NO: 13219 - DNA, 25 bp, Homo sapiens
ttctgggcaccatggaggatggcaa

SEQ ID NO: 13220 - DNA, 25 bp, Homo sapiens
tctgggcaccatggaggatggcaag

SEQ ID NO: 13221 - DNA, 25 bp, Homo sapiens
ctgggcaccatggaggatggcaaga

SEQ ID NO: 13222 - DNA, 25 bp, Homo sapiens
tgggcaccatggaggatggcaagac

SEQ ID NO: 13223 - DNA, 25 bp, Homo sapiens
gggcaccatggaggatggcaagaca

SEQ ID NO: 13224 - DNA, 25 bp, Homo sapiens
ggcaccatggaggatggcaagacat

SEQ ID NO: 13225 - DNA, 25 bp, Homo sapiens
gcaccatggaggatggcaagacatc

SEQ ID NO: 13226 - DNA, 25 bp, Homo sapiens
caccatggaggatggcaagacatca

SEQ ID NO: 13227 - DNA, 25 bp, Homo sapiens
accatggaggatggcaagacatcag

SEQ ID NO: 13228 - DNA, 25 bp, Homo sapiens
ccatggaggatggcaagacatcagt

SEQ ID NO: 13229 - DNA, 25 bp, Homo sapiens
catggaggatggcaagacatcagtc

SEQ ID NO: 13230 - DNA, 25 bp, Homo sapiens
atggaggatggcaagacatcagtca

SEQ ID NO: 13231 - DNA, 25 bp, Homo sapiens
tggaggatggcaagacatcagtcag

SEQ ID NO: 13232 - DNA, 25 bp, Homo sapiens
ggaggatggcaagacatcagtcagc

SEQ ID NO: 13233 - DNA, 25 bp, Homo sapiens
gaggatggcaagacatcagtcagca

SEQ ID NO: 13234 - DNA, 25 bp, Homo sapiens
aggatggcaagacatcagtcagcaa

SEQ ID NO: 13235 - DNA, 25 bp, Homo sapiens
ggatggcaagacatcagtcagcaag

SEQ ID NO: 13236 - DNA, 25 bp, Homo sapiens
gatggcaagacatcagtcagcaagg

SEQ ID NO: 13237 - DNA, 25 bp, Homo sapiens
atggcaagacatcagtcagcaagga

SEQ ID NO: 13238 - DNA, 25 bp, Homo sapiens
tggcaagacatcagtcagcaaggag

SEQ ID NO: 13239 - DNA, 25 bp, Homo sapiens
ggcaagacatcagtcagcaaggagg

SEQ ID NO: 13240 - DNA, 25 bp, Homo sapiens
gcaagacatcagtcagcaaggagga

SEQ ID NO: 13241 - DNA, 25 bp, Homo sapiens
caagacatcagtcagcaaggaggag

SEQ ID NO: 13242 - DNA, 25 bp, Homo sapiens
aagacatcagtcagcaaggaggagc

SEQ ID NO: 13243 - DNA, 25 bp, Homo sapiens
agacatcagtcagcaaggaggagct

SEQ ID NO: 13244 - DNA, 25 bp, Homo sapiens
gacatcagtcagcaaggaggagctg

SEQ ID NO: 13245 - DNA, 25 bp, Homo sapiens
acatcagtcagcaaggaggagctgg

SEQ ID NO: 13246 - DNA, 25 bp, Homo sapiens
catcagtcagcaaggaggagctgga

SEQ ID NO: 13247 - DNA, 25 bp, Homo sapiens
atcagtcagcaaggaggagctggag

SEQ ID NO: 13248 - DNA, 25 bp, Homo sapiens
tcagtcagcaaggaggagctggaga

SEQ ID NO: 13249 - DNA, 25 bp, Homo sapiens
cagtcagcaaggaggagctggagaa

SEQ ID NO: 13250 - DNA, 25 bp, Homo sapiens
agtcagcaaggaggagctggagaaa

SEQ ID NO: 13251 - DNA, 25 bp, Homo sapiens
gtcagcaaggaggagctggagaaag

SEQ ID NO: 13252 - DNA, 25 bp, Homo sapiens
tcagcaaggaggagctggagaaagt

SEQ ID NO: 13253 - DNA, 25 bp, Homo sapiens
cagcaaggaggagctggagaaagtg

SEQ ID NO: 13254 - DNA, 25 bp, Homo sapiens
agcaaggaggagctggagaaagtgc

SEQ ID NO: 13255 - DNA, 25 bp, Homo sapiens
gcaaggaggagctggagaaagtgca

SEQ ID NO: 13256 - DNA, 25 bp, Homo sapiens
caaggaggagctggagaaagtgcac

SEQ ID NO: 13257 - DNA, 25 bp, Homo sapiens
aaggaggagctggagaaagtgcaca

SEQ ID NO: 13258 - DNA, 25 bp, Homo sapiens
aggaggagctggagaaagtgcacag

SEQ ID NO: 13259 - DNA, 25 bp, Homo sapiens
ggaggagctggagaaagtgcacagc

SEQ ID NO: 13260 - DNA, 25 bp, Homo sapiens
gaggagctggagaaagtgcacagcc

SEQ ID NO: 13261 - DNA, 25 bp, Homo sapiens
aggagctggagaaagtgcacagcca

SEQ ID NO: 13262 - DNA, 25 bp, Homo sapiens
ggagctggagaaagtgcacagccag

SEQ ID NO: 13263 - DNA, 25 bp, Homo sapiens
gagctggagaaagtgcacagccagc

SEQ ID NO: 13264 - DNA, 25 bp, Homo sapiens
agctggagaaagtgcacagccagct

SEQ ID NO: 13265 - DNA, 25 bp, Homo sapiens
gctggagaaagtgcacagccagctg

SEQ ID NO: 13266 - DNA, 25 bp, Homo sapiens
ctggagaaagtgcacagccagctgg

SEQ ID NO: 13267 - DNA, 25 bp, Homo sapiens
tggagaaagtgcacagccagctgga

SEQ ID NO: 13268 - DNA, 25 bp, Homo sapiens
ggagaaagtgcacagccagctggag

SEQ ID NO: 13269 - DNA, 25 bp, Homo sapiens
gagaaagtgcacagccagctggagc

SEQ ID NO: 13270 - DNA, 25 bp, Homo sapiens
agaaagtgcacagccagctggagca

SEQ ID NO: 13271 - DNA, 25 bp, Homo sapiens
gaaagtgcacagccagctggagcag

SEQ ID NO: 13272 - DNA, 25 bp, Homo sapiens
aaagtgcacagccagctggagcaga

SEQ ID NO: 13273 - DNA, 25 bp, Homo sapiens
aagtgcacagccagctggagcagag

SEQ ID NO: 13274 - DNA, 25 bp, Homo sapiens
agtgcacagccagctggagcagagt

SEQ ID NO: 13275 - DNA, 25 bp, Homo sapiens
gtgcacagccagctggagcagagtg

SEQ ID NO: 13276 - DNA, 25 bp, Homo sapiens
tgcacagccagctggagcagagtga

SEQ ID NO: 13277 - DNA, 25 bp, Homo sapiens
gcacagccagctggagcagagtgaa

SEQ ID NO: 13278 - DNA, 25 bp, Homo sapiens
cacagccagctggagcagagtgaag

SEQ ID NO: 13279 - DNA, 25 bp, Homo sapiens
acagccagctggagcagagtgaagc

SEQ ID NO: 13280 - DNA, 25 bp, Homo sapiens
cagccagctggagcagagtgaagcc

SEQ ID NO: 13281 - DNA, 25 bp, Homo sapiens
agccagctggagcagagtgaagcca

SEQ ID NO: 13282 - DNA, 25 bp, Homo sapiens
gccagctggagcagagtgaagccaa

SEQ ID NO: 13283 - DNA, 25 bp, Homo sapiens
ccagctggagcagagtgaagccaag

SEQ ID NO: 13284 - DNA, 25 bp, Homo sapiens
cagctggagcagagtgaagccaagt

SEQ ID NO: 13285 - DNA, 25 bp, Homo sapiens
agctggagcagagtgaagccaagtg

SEQ ID NO: 13286 - DNA, 25 bp, Homo sapiens
gctggagcagagtgaagccaagtgt

SEQ ID NO: 13287 - DNA, 25 bp, Homo sapiens
ctggagcagagtgaagccaagtgtg

SEQ ID NO: 13288 - DNA, 25 bp, Homo sapiens
tggagcagagtgaagccaagtgtga

SEQ ID NO: 13289 - DNA, 25 bp, Homo sapiens
ggagcagagtgaagccaagtgtgag

SEQ ID NO: 13290 - DNA, 25 bp, Homo sapiens
gagcagagtgaagccaagtgtgagg

SEQ ID NO: 13291 - DNA, 25 bp, Homo sapiens
agcagagtgaagccaagtgtgagga

SEQ ID NO: 13292 - DNA, 25 bp, Homo sapiens
gcagagtgaagccaagtgtgaggag

SEQ ID NO: 13293 - DNA, 25 bp, Homo sapiens
cagagtgaagccaagtgtgaggagg

SEQ ID NO: 13294 - DNA, 25 bp, Homo sapiens
agagtgaagccaagtgtgaggaggc

SEQ ID NO: 13295 - DNA, 25 bp, Homo sapiens
gagtgaagccaagtgtgaggaggcc

SEQ ID NO: 13296 - DNA, 25 bp, Homo sapiens
agtgaagccaagtgtgaggaggcct

SEQ ID NO: 13297 - DNA, 25 bp, Homo sapiens
gtgaagccaagtgtgaggaggcctt

SEQ ID NO: 13298 - DNA, 25 bp, Homo sapiens
tgaagccaagtgtgaggaggccttg

SEQ ID NO: 13299 - DNA, 25 bp, Homo sapiens
gaagccaagtgtgaggaggccttga

SEQ ID NO: 13300 - DNA, 25 bp, Homo sapiens
aagccaagtgtgaggaggccttgaa

SEQ ID NO: 13301 - DNA, 25 bp, Homo sapiens
agccaagtgtgaggaggccttgaag

SEQ ID NO: 13302 - DNA, 25 bp, Homo sapiens
gccaagtgtgaggaggccttgaaga

SEQ ID NO: 13303 - DNA, 25 bp, Homo sapiens
ccaagtgtgaggaggccttgaagac

SEQ ID NO: 13304 - DNA, 25 bp, Homo sapiens
caagtgtgaggaggccttgaagacg

SEQ ID NO: 13305 - DNA, 25 bp, Homo sapiens
aagtgtgaggaggccttgaagacgc

SEQ ID NO: 13306 - DNA, 25 bp, Homo sapiens
agtgtgaggaggccttgaagacgca

SEQ ID NO: 13307 - DNA, 25 bp, Homo sapiens
gtgtgaggaggccttgaagacgcag

SEQ ID NO: 13308 - DNA, 25 bp, Homo sapiens
tgtgaggaggccttgaagacgcaga

SEQ ID NO: 13309 - DNA, 25 bp, Homo sapiens
gtgaggaggccttgaagacgcagaa

SEQ ID NO: 13310 - DNA, 25 bp, Homo sapiens
tgaggaggccttgaagacgcagaag

SEQ ID NO: 13311 - DNA, 25 bp, Homo sapiens
gaggaggccttgaagacgcagaagg

SEQ ID NO: 13312 - DNA, 25 bp, Homo sapiens
aggaggccttgaagacgcagaaggt

SEQ ID NO: 13313 - DNA, 25 bp, Homo sapiens
ggaggccttgaagacgcagaaggtg

SEQ ID NO: 13314 - DNA, 25 bp, Homo sapiens
gaggccttgaagacgcagaaggtgc

SEQ ID NO: 13315 - DNA, 25 bp, Homo sapiens
aggccttgaagacgcagaaggtgct

SEQ ID NO: 13316 - DNA, 25 bp, Homo sapiens
ggccttgaagacgcagaaggtgctc

SEQ ID NO: 13317 - DNA, 25 bp, Homo sapiens
gccttgaagacgcagaaggtgctca

SEQ ID NO: 13318 - DNA, 25 bp, Homo sapiens
ccttgaagacgcagaaggtgctcac

SEQ ID NO: 13319 - DNA, 25 bp, Homo sapiens
cttgaagacgcagaaggtgctcaca

SEQ ID NO: 13320 - DNA, 25 bp, Homo sapiens
ttgaagacgcagaaggtgctcacag

SEQ ID NO: 13321 - DNA, 25 bp, Homo sapiens
tgaagacgcagaaggtgctcacagc

SEQ ID NO: 13322 - DNA, 25 bp, Homo sapiens
gaagacgcagaaggtgctcacagcg

SEQ ID NO: 13323 - DNA, 25 bp, Homo sapiens
aagacgcagaaggtgctcacagcgg

SEQ ID NO: 13324 - DNA, 25 bp, Homo sapiens
agacgcagaaggtgctcacagcgga

SEQ ID NO: 13325 - DNA, 25 bp, Homo sapiens
gacgcagaaggtgctcacagcggac

SEQ ID NO: 13326 - DNA, 25 bp, Homo sapiens
acgcagaaggtgctcacagcggacc

SEQ ID NO: 13327 - DNA, 25 bp, Homo sapiens
cgcagaaggtgctcacagcggacct

SEQ ID NO: 13328 - DNA, 25 bp, Homo sapiens
gcagaaggtgctcacagcggacctg

SEQ ID NO: 13329 - DNA, 25 bp, Homo sapiens
cagaaggtgctcacagcggacctgg

SEQ ID NO: 13330 - DNA, 25 bp, Homo sapiens
agaaggtgctcacagcggacctgga

SEQ ID NO: 13331 - DNA, 25 bp, Homo sapiens
gaaggtgctcacagcggacctggag

SEQ ID NO: 13332 - DNA, 25 bp, Homo sapiens
aaggtgctcacagcggacctggaga

SEQ ID NO: 13333 - DNA, 25 bp, Homo sapiens
aggtgctcacagcggacctggagag

SEQ ID NO: 13334 - DNA, 25 bp, Homo sapiens
ggtgctcacagcggacctggagagc

SEQ ID NO: 13335 - DNA, 25 bp, Homo sapiens
gtgctcacagcggacctggagagca

SEQ ID NO: 13336 - DNA, 25 bp, Homo sapiens
tgctcacagcggacctggagagcat

SEQ ID NO: 13337 - DNA, 25 bp, Homo sapiens
gctcacagcggacctggagagcatg

SEQ ID NO: 13338 - DNA, 25 bp, Homo sapiens
ctcacagcggacctggagagcatgc

SEQ ID NO: 13339 - DNA, 25 bp, Homo sapiens
tcacagcggacctggagagcatgca

SEQ ID NO: 13340 - DNA, 25 bp, Homo sapiens
cacagcggacctggagagcatgcac

SEQ ID NO: 13341 - DNA, 25 bp, Homo sapiens
acagcggacctggagagcatgcaca

SEQ ID NO: 13342 - DNA, 25 bp, Homo sapiens
cagcggacctggagagcatgcacag

SEQ ID NO: 13343 - DNA, 25 bp, Homo sapiens
agcggacctggagagcatgcacagc

SEQ ID NO: 13344 - DNA, 25 bp, Homo sapiens
gcggacctggagagcatgcacagcg

SEQ ID NO: 13345 - DNA, 25 bp, Homo sapiens
cggacctggagagcatgcacagcga

SEQ ID NO: 13346 - DNA, 25 bp, Homo sapiens
ggacctggagagcatgcacagcgag

SEQ ID NO: 13347 - DNA, 25 bp, Homo sapiens
gacctggagagcatgcacagcgagc

SEQ ID NO: 13348 - DNA, 25 bp, Homo sapiens
acctggagagcatgcacagcgagct

SEQ ID NO: 13349 - DNA, 25 bp, Homo sapiens
cctggagagcatgcacagcgagctg

SEQ ID NO: 13350 - DNA, 25 bp, Homo sapiens
ctggagagcatgcacagcgagctgg

SEQ ID NO: 13351 - DNA, 25 bp, Homo sapiens
tggagagcatgcacagcgagctgga

SEQ ID NO: 13352 - DNA, 25 bp, Homo sapiens
ggagagcatgcacagcgagctggag

SEQ ID NO: 13353 - DNA, 25 bp, Homo sapiens
gagagcatgcacagcgagctggaga

SEQ ID NO: 13354 - DNA, 25 bp, Homo sapiens
agagcatgcacagcgagctggagaa

SEQ ID NO: 13355 - DNA, 25 bp, Homo sapiens
gagcatgcacagcgagctggagaac

SEQ ID NO: 13356 - DNA, 25 bp, Homo sapiens
agcatgcacagcgagctggagaaca

SEQ ID NO: 13357 - DNA, 25 bp, Homo sapiens
gcatgcacagcgagctggagaacat

SEQ ID NO: 13358 - DNA, 25 bp, Homo sapiens
catgcacagcgagctggagaacatg

SEQ ID NO: 13359 - DNA, 25 bp, Homo sapiens
atgcacagcgagctggagaacatga

SEQ ID NO: 13360 - DNA, 25 bp, Homo sapiens
tgcacagcgagctggagaacatgac

SEQ ID NO: 13361 - DNA, 25 bp, Homo sapiens
gcacagcgagctggagaacatgacg

SEQ ID NO: 13362 - DNA, 25 bp, Homo sapiens
cacagcgagctggagaacatgacgc

SEQ ID NO: 13363 - DNA, 25 bp, Homo sapiens
acagcgagctggagaacatgacgcg

SEQ ID NO: 13364 - DNA, 25 bp, Homo sapiens
cagcgagctggagaacatgacgcgg

SEQ ID NO: 13365 - DNA, 25 bp, Homo sapiens
agcgagctggagaacatgacgcgga

SEQ ID NO: 13366 - DNA, 25 bp, Homo sapiens
gcgagctggagaacatgacgcggaa

SEQ ID NO: 13367 - DNA, 25 bp, Homo sapiens
cgagctggagaacatgacgcggaac

SEQ ID NO: 13368 - DNA, 25 bp, Homo sapiens
gagctggagaacatgacgcggaaca

SEQ ID NO: 13369 - DNA, 25 bp, Homo sapiens
agctggagaacatgacgcggaacaa

SEQ ID NO: 13370 - DNA, 25 bp, Homo sapiens
gctggagaacatgacgcggaacaag

SEQ ID NO: 13371 - DNA, 25 bp, Homo sapiens
ctggagaacatgacgcggaacaaga

SEQ ID NO: 13372 - DNA, 25 bp, Homo sapiens
tggagaacatgacgcggaacaagag

SEQ ID NO: 13373 - DNA, 25 bp, Homo sapiens
ggagaacatgacgcggaacaagagc

SEQ ID NO: 13374 - DNA, 25 bp, Homo sapiens
gagaacatgacgcggaacaagagcc

SEQ ID NO: 13375 - DNA, 25 bp, Homo sapiens
agaacatgacgcggaacaagagcct

SEQ ID NO: 13376 - DNA, 25 bp, Homo sapiens
gaacatgacgcggaacaagagcctg

SEQ ID NO: 13377 - DNA, 25 bp, Homo sapiens
aacatgacgcggaacaagagcctgg

SEQ ID NO: 13378 - DNA, 25 bp, Homo sapiens
acatgacgcggaacaagagcctggt

SEQ ID NO: 13379 - DNA, 25 bp, Homo sapiens
catgacgcggaacaagagcctggtg

SEQ ID NO: 13380 - DNA, 25 bp, Homo sapiens
atgacgcggaacaagagcctggtgg

SEQ ID NO: 13381 - DNA, 25 bp, Homo sapiens
tgacgcggaacaagagcctggtgga

SEQ ID NO: 13382 - DNA, 25 bp, Homo sapiens
gacgcggaacaagagcctggtggat

SEQ ID NO: 13383 - DNA, 25 bp, Homo sapiens
acgcggaacaagagcctggtggatg

SEQ ID NO: 13384 - DNA, 25 bp, Homo sapiens
cgcggaacaagagcctggtggatga

SEQ ID NO: 13385 - DNA, 25 bp, Homo sapiens
gcggaacaagagcctggtggatgag

SEQ ID NO: 13386 - DNA, 25 bp, Homo sapiens
cggaacaagagcctggtggatgagc

SEQ ID NO: 13387 - DNA, 25 bp, Homo sapiens
ggaacaagagcctggtggatgagca

SEQ ID NO: 13388 - DNA, 25 bp, Homo sapiens
gaacaagagcctggtggatgagcag

SEQ ID NO: 13389 - DNA, 25 bp, Homo sapiens
aacaagagcctggtggatgagcagc

SEQ ID NO: 13390 - DNA, 25 bp, Homo sapiens
acaagagcctggtggatgagcagct

SEQ ID NO: 13391 - DNA, 25 bp, Homo sapiens
caagagcctggtggatgagcagctg

SEQ ID NO: 13392 - DNA, 25 bp, Homo sapiens
aagagcctggtggatgagcagctgt

SEQ ID NO: 13393 - DNA, 25 bp, Homo sapiens
agagcctggtggatgagcagctgta

SEQ ID NO: 13394 - DNA, 25 bp, Homo sapiens
gagcctggtggatgagcagctgtac

SEQ ID NO: 13395 - DNA, 25 bp, Homo sapiens
agcctggtggatgagcagctgtaca

SEQ ID NO: 13396 - DNA, 25 bp, Homo sapiens
gcctggtggatgagcagctgtacag

SEQ ID NO: 13397 - DNA, 25 bp, Homo sapiens
cctggtggatgagcagctgtacagg

SEQ ID NO: 13398 - DNA, 25 bp, Homo sapiens
ctggtggatgagcagctgtacaggc

SEQ ID NO: 13399 - DNA, 25 bp, Homo sapiens
tggtggatgagcagctgtacaggct

SEQ ID NO: 13400 - DNA, 25 bp, Homo sapiens
ggtggatgagcagctgtacaggctg

SEQ ID NO: 13401 - DNA, 25 bp, Homo sapiens
gtggatgagcagctgtacaggctgc

SEQ ID NO: 13402 - DNA, 25 bp, Homo sapiens
tggatgagcagctgtacaggctgca

SEQ ID NO: 13403 - DNA, 25 bp, Homo sapiens
ggatgagcagctgtacaggctgcag

SEQ ID NO: 13404 - DNA, 25 bp, Homo sapiens
gatgagcagctgtacaggctgcagt

SEQ ID NO: 13405 - DNA, 25 bp, Homo sapiens
atgagcagctgtacaggctgcagtt

SEQ ID NO: 13406 - DNA, 25 bp, Homo sapiens
tgagcagctgtacaggctgcagttt

SEQ ID NO: 13407 - DNA, 25 bp, Homo sapiens
gagcagctgtacaggctgcagtttg

SEQ ID NO: 13408 - DNA, 25 bp, Homo sapiens
agcagctgtacaggctgcagtttga

SEQ ID NO: 13409 - DNA, 25 bp, Homo sapiens
gcagctgtacaggctgcagtttgag

SEQ ID NO: 13410 - DNA, 25 bp, Homo sapiens
cagctgtacaggctgcagtttgaga

SEQ ID NO: 13411 - DNA, 25 bp, Homo sapiens
agctgtacaggctgcagtttgagaa

SEQ ID NO: 13412 - DNA, 25 bp, Homo sapiens
gctgtacaggctgcagtttgagaag

SEQ ID NO: 13413 - DNA, 25 bp, Homo sapiens
ctgtacaggctgcagtttgagaagg

SEQ ID NO: 13414 - DNA, 25 bp, Homo sapiens
tgtacaggctgcagtttgagaaggc

SEQ ID NO: 13415 - DNA, 25 bp, Homo sapiens
gtacaggctgcagtttgagaaggcg

SEQ ID NO: 13416 - DNA, 25 bp, Homo sapiens
tacaggctgcagtttgagaaggcgg

SEQ ID NO: 13417 - DNA, 25 bp, Homo sapiens
acaggctgcagtttgagaaggcgga

SEQ ID NO: 13418 - DNA, 25 bp, Homo sapiens
caggctgcagtttgagaaggcggac

SEQ ID NO: 13419 - DNA, 25 bp, Homo sapiens
aggctgcagtttgagaaggcggacc

SEQ ID NO: 13420 - DNA, 25 bp, Homo sapiens
ggctgcagtttgagaaggcggacct

SEQ ID NO: 13421 - DNA, 25 bp, Homo sapiens
gctgcagtttgagaaggcggacctc

SEQ ID NO: 13422 - DNA, 25 bp, Homo sapiens
ctgcagtttgagaaggcggacctcc

SEQ ID NO: 13423 - DNA, 25 bp, Homo sapiens
tgcagtttgagaaggcggacctcct

SEQ ID NO: 13424 - DNA, 25 bp, Homo sapiens
gcagtttgagaaggcggacctcctg

SEQ ID NO: 13425 - DNA, 25 bp, Homo sapiens
cagtttgagaaggcggacctcctga

SEQ ID NO: 13426 - DNA, 25 bp, Homo sapiens
agtttgagaaggcggacctcctgaa

SEQ ID NO: 13427 - DNA, 25 bp, Homo sapiens
gtttgagaaggcggacctcctgaag

SEQ ID NO: 13428 - DNA, 25 bp, Homo sapiens
tttgagaaggcggacctcctgaagc

SEQ ID NO: 13429 - DNA, 25 bp, Homo sapiens
ttgagaaggcggacctcctgaagcg

SEQ ID NO: 13430 - DNA, 25 bp, Homo sapiens
tgagaaggcggacctcctgaagcgc

SEQ ID NO: 13431 - DNA, 25 bp, Homo sapiens
gagaaggcggacctcctgaagcgca

SEQ ID NO: 13432 - DNA, 25 bp, Homo sapiens
agaaggcggacctcctgaagcgcat

SEQ ID NO: 13433 - DNA, 25 bp, Homo sapiens
gaaggcggacctcctgaagcgcatc

SEQ ID NO: 13434 - DNA, 25 bp, Homo sapiens
aaggcggacctcctgaagcgcatcg

SEQ ID NO: 13435 - DNA, 25 bp, Homo sapiens
aggcggacctcctgaagcgcatcga

SEQ ID NO: 13436 - DNA, 25 bp, Homo sapiens
ggcggacctcctgaagcgcatcgat

SEQ ID NO: 13437 - DNA, 25 bp, Homo sapiens
gcggacctcctgaagcgcatcgatg

SEQ ID NO: 13438 - DNA, 25 bp, Homo sapiens
cggacctcctgaagcgcatcgatga

SEQ ID NO: 13439 - DNA, 25 bp, Homo sapiens
ggacctcctgaagcgcatcgatgag

SEQ ID NO: 13440 - DNA, 25 bp, Homo sapiens
gacctcctgaagcgcatcgatgagg

SEQ ID NO: 13441 - DNA, 25 bp, Homo sapiens
acctcctgaagcgcatcgatgagga

SEQ ID NO: 13442 - DNA, 25 bp, Homo sapiens
cctcctgaagcgcatcgatgaggac

SEQ ID NO: 13443 - DNA, 25 bp, Homo sapiens
ctcctgaagcgcatcgatgaggacc

SEQ ID NO: 13444 - DNA, 25 bp, Homo sapiens
tcctgaagcgcatcgatgaggacca

SEQ ID NO: 13445 - DNA, 25 bp, Homo sapiens
cctgaagcgcatcgatgaggaccag

SEQ ID NO: 13446 - DNA, 25 bp, Homo sapiens
ctgaagcgcatcgatgaggaccagg

SEQ ID NO: 13447 - DNA, 25 bp, Homo sapiens
tgaagcgcatcgatgaggaccagga

SEQ ID NO: 13448 - DNA, 25 bp, Homo sapiens
gaagcgcatcgatgaggaccaggat

SEQ ID NO: 13449 - DNA, 25 bp, Homo sapiens
aagcgcatcgatgaggaccaggatg

SEQ ID NO: 13450 - DNA, 25 bp, Homo sapiens
agcgcatcgatgaggaccaggatga

SEQ ID NO: 13451 - DNA, 25 bp, Homo sapiens
gcgcatcgatgaggaccaggatgac

SEQ ID NO: 13452 - DNA, 25 bp, Homo sapiens
cgcatcgatgaggaccaggatgacc

SEQ ID NO: 13453 - DNA, 25 bp, Homo sapiens
gcatcgatgaggaccaggatgacct

SEQ ID NO: 13454 - DNA, 25 bp, Homo sapiens
catcgatgaggaccaggatgacctg

SEQ ID NO: 13455 - DNA, 25 bp, Homo sapiens
atcgatgaggaccaggatgacctga

SEQ ID NO: 13456 - DNA, 25 bp, Homo sapiens
tcgatgaggaccaggatgacctgaa

SEQ ID NO: 13457 - DNA, 25 bp, Homo sapiens
cgatgaggaccaggatgacctgaat

SEQ ID NO: 13458 - DNA, 25 bp, Homo sapiens
gatgaggaccaggatgacctgaatg

SEQ ID NO: 13459 - DNA, 25 bp, Homo sapiens
atgaggaccaggatgacctgaatga

SEQ ID NO: 13460 - DNA, 25 bp, Homo sapiens
tgaggaccaggatgacctgaatgag

SEQ ID NO: 13461 - DNA, 25 bp, Homo sapiens
gaggaccaggatgacctgaatgagc

SEQ ID NO: 13462 - DNA, 25 bp, Homo sapiens
aggaccaggatgacctgaatgagct

SEQ ID NO: 13463 - DNA, 25 bp, Homo sapiens
ggaccaggatgacctgaatgagctg

SEQ ID NO: 13464 - DNA, 25 bp, Homo sapiens
gaccaggatgacctgaatgagctga

SEQ ID NO: 13465 - DNA, 25 bp, Homo sapiens
accaggatgacctgaatgagctgat

SEQ ID NO: 13466 - DNA, 25 bp, Homo sapiens
ccaggatgacctgaatgagctgatg

SEQ ID NO: 13467 - DNA, 25 bp, Homo sapiens
caggatgacctgaatgagctgatgc

SEQ ID NO: 13468 - DNA, 25 bp, Homo sapiens
aggatgacctgaatgagctgatgca

SEQ ID NO: 13469 - DNA, 25 bp, Homo sapiens
ggatgacctgaatgagctgatgcag

SEQ ID NO: 13470 - DNA, 25 bp, Homo sapiens
gatgacctgaatgagctgatgcaga

SEQ ID NO: 13471 - DNA, 25 bp, Homo sapiens
atgacctgaatgagctgatgcagaa

SEQ ID NO: 13472 - DNA, 25 bp, Homo sapiens
tgacctgaatgagctgatgcagaag

SEQ ID NO: 13473 - DNA, 25 bp, Homo sapiens
gacctgaatgagctgatgcagaagc

SEQ ID NO: 13474 - DNA, 25 bp, Homo sapiens
acctgaatgagctgatgcagaagca

SEQ ID NO: 13475 - DNA, 25 bp, Homo sapiens
cctgaatgagctgatgcagaagcac

SEQ ID NO: 13476 - DNA, 25 bp, Homo sapiens
ctgaatgagctgatgcagaagcaca

SEQ ID NO: 13477 - DNA, 25 bp, Homo sapiens
tgaatgagctgatgcagaagcacaa

SEQ ID NO: 13478 - DNA, 25 bp, Homo sapiens
gaatgagctgatgcagaagcacaag

SEQ ID NO: 13479 - DNA, 25 bp, Homo sapiens
aatgagctgatgcagaagcacaagg

SEQ ID NO: 13480 - DNA, 25 bp, Homo sapiens
atgagctgatgcagaagcacaagga

SEQ ID NO: 13481 - DNA, 25 bp, Homo sapiens
tgagctgatgcagaagcacaaggac

SEQ ID NO: 13482 - DNA, 25 bp, Homo sapiens
gagctgatgcagaagcacaaggacc

SEQ ID NO: 13483 - DNA, 25 bp, Homo sapiens
agctgatgcagaagcacaaggacct

SEQ ID NO: 13484 - DNA, 25 bp, Homo sapiens
gctgatgcagaagcacaaggacctc

SEQ ID NO: 13485 - DNA, 25 bp, Homo sapiens
ctgatgcagaagcacaaggacctca

SEQ ID NO: 13486 - DNA, 25 bp, Homo sapiens
tgatgcagaagcacaaggacctcat

SEQ ID NO: 13487 - DNA, 25 bp, Homo sapiens
gatgcagaagcacaaggacctcatt

SEQ ID NO: 13488 - DNA, 25 bp, Homo sapiens
atgcagaagcacaaggacctcattg

SEQ ID NO: 13489 - DNA, 25 bp, Homo sapiens
tgcagaagcacaaggacctcattgc

SEQ ID NO: 13490 - DNA, 25 bp, Homo sapiens
gcagaagcacaaggacctcattgct

SEQ ID NO: 13491 - DNA, 25 bp, Homo sapiens
cagaagcacaaggacctcattgctc

SEQ ID NO: 13492 - DNA, 25 bp, Homo sapiens
agaagcacaaggacctcattgctca

SEQ ID NO: 13493 - DNA, 25 bp, Homo sapiens
gaagcacaaggacctcattgctcag

SEQ ID NO: 13494 - DNA, 25 bp, Homo sapiens
aagcacaaggacctcattgctcagt

SEQ ID NO: 13495 - DNA, 25 bp, Homo sapiens
agcacaaggacctcattgctcagtc

SEQ ID NO: 13496 - DNA, 25 bp, Homo sapiens
gcacaaggacctcattgctcagtct

SEQ ID NO: 13497 - DNA, 25 bp, Homo sapiens
cacaaggacctcattgctcagtctg

SEQ ID NO: 13498 - DNA, 25 bp, Homo sapiens
acaaggacctcattgctcagtctgc

SEQ ID NO: 13499 - DNA, 25 bp, Homo sapiens
caaggacctcattgctcagtctgct

SEQ ID NO: 13500 - DNA, 25 bp, Homo sapiens
aaggacctcattgctcagtctgctg

SEQ ID NO: 13501 - DNA, 25 bp, Homo sapiens
aggacctcattgctcagtctgctgc

SEQ ID NO: 13502 - DNA, 25 bp, Homo sapiens
ggacctcattgctcagtctgctgct

SEQ ID NO: 13503 - DNA, 25 bp, Homo sapiens
gacctcattgctcagtctgctgctg

SEQ ID NO: 13504 - DNA, 25 bp, Homo sapiens
acctcattgctcagtctgctgctga

SEQ ID NO: 13505 - DNA, 25 bp, Homo sapiens
cctcattgctcagtctgctgctgac

SEQ ID NO: 13506 - DNA, 25 bp, Homo sapiens
ctcattgctcagtctgctgctgaca

SEQ ID NO: 13507 - DNA, 25 bp, Homo sapiens
tcattgctcagtctgctgctgacat

SEQ ID NO: 13508 - DNA, 25 bp, Homo sapiens
cattgctcagtctgctgctgacatt

SEQ ID NO: 13509 - DNA, 25 bp, Homo sapiens
attgctcagtctgctgctgacattg

SEQ ID NO: 13510 - DNA, 25 bp, Homo sapiens
ttgctcagtctgctgctgacattgg

SEQ ID NO: 13511 - DNA, 25 bp, Homo sapiens
tgctcagtctgctgctgacattggg

SEQ ID NO: 13512 - DNA, 25 bp, Homo sapiens
gctcagtctgctgctgacattgggc

SEQ ID NO: 13513 - DNA, 25 bp, Homo sapiens
ctcagtctgctgctgacattgggca

SEQ ID NO: 13514 - DNA, 25 bp, Homo sapiens
tcagtctgctgctgacattgggcag

SEQ ID NO: 13515 - DNA, 25 bp, Homo sapiens
cagtctgctgctgacattgggcaga

SEQ ID NO: 13516 - DNA, 25 bp, Homo sapiens
agtctgctgctgacattgggcagat

SEQ ID NO: 13517 - DNA, 25 bp, Homo sapiens
gtctgctgctgacattgggcagatc

SEQ ID NO: 13518 - DNA, 25 bp, Homo sapiens
tctgctgctgacattgggcagatcc

SEQ ID NO: 13519 - DNA, 25 bp, Homo sapiens
ctgctgctgacattgggcagatcca

SEQ ID NO: 13520 - DNA, 25 bp, Homo sapiens
tgctgctgacattgggcagatccaa

SEQ ID NO: 13521 - DNA, 25 bp, Homo sapiens
gctgctgacattgggcagatccaag

SEQ ID NO: 13522 - DNA, 25 bp, Homo sapiens
ctgctgacattgggcagatccaaga

SEQ ID NO: 13523 - DNA, 25 bp, Homo sapiens
tgctgacattgggcagatccaagaa

SEQ ID NO: 13524 - DNA, 25 bp, Homo sapiens
gctgacattgggcagatccaagaac

SEQ ID NO: 13525 - DNA, 25 bp, Homo sapiens
ctgacattgggcagatccaagaact

SEQ ID NO: 13526 - DNA, 25 bp, Homo sapiens
tgacattgggcagatccaagaactg

SEQ ID NO: 13527 - DNA, 25 bp, Homo sapiens
gacattgggcagatccaagaactgc

SEQ ID NO: 13528 - DNA, 25 bp, Homo sapiens
acattgggcagatccaagaactgca

SEQ ID NO: 13529 - DNA, 25 bp, Homo sapiens
cattgggcagatccaagaactgcag

SEQ ID NO: 13530 - DNA, 25 bp, Homo sapiens
attgggcagatccaagaactgcagc

SEQ ID NO: 13531 - DNA, 25 bp, Homo sapiens
ttgggcagatccaagaactgcagct

SEQ ID NO: 13532 - DNA, 25 bp, Homo sapiens
tgggcagatccaagaactgcagctg

SEQ ID NO: 13533 - DNA, 25 bp, Homo sapiens
gggcagatccaagaactgcagctgc

SEQ ID NO: 13534 - DNA, 25 bp, Homo sapiens
ggcagatccaagaactgcagctgca

SEQ ID NO: 13535 - DNA, 25 bp, Homo sapiens
gcagatccaagaactgcagctgcag

SEQ ID NO: 13536 - DNA, 25 bp, Homo sapiens
cagatccaagaactgcagctgcagc

SEQ ID NO: 13537 - DNA, 25 bp, Homo sapiens
agatccaagaactgcagctgcagct

SEQ ID NO: 13538 - DNA, 25 bp, Homo sapiens
gatccaagaactgcagctgcagctg

SEQ ID NO: 13539 - DNA, 25 bp, Homo sapiens
atccaagaactgcagctgcagctgg

SEQ ID NO: 13540 - DNA, 25 bp, Homo sapiens
tccaagaactgcagctgcagctgga

SEQ ID NO: 13541 - DNA, 25 bp, Homo sapiens
ccaagaactgcagctgcagctggag

SEQ ID NO: 13542 - DNA, 25 bp, Homo sapiens
caagaactgcagctgcagctggagg

SEQ ID NO: 13543 - DNA, 25 bp, Homo sapiens
aagaactgcagctgcagctggagga

SEQ ID NO: 13544 - DNA, 25 bp, Homo sapiens
agaactgcagctgcagctggaggaa

SEQ ID NO: 13545 - DNA, 25 bp, Homo sapiens
gaactgcagctgcagctggaggaag

SEQ ID NO: 13546 - DNA, 25 bp, Homo sapiens
aactgcagctgcagctggaggaagc

SEQ ID NO: 13547 - DNA, 25 bp, Homo sapiens
actgcagctgcagctggaggaagcc

SEQ ID NO: 13548 - DNA, 25 bp, Homo sapiens
ctgcagctgcagctggaggaagcca

SEQ ID NO: 13549 - DNA, 25 bp, Homo sapiens
tgcagctgcagctggaggaagccaa

SEQ ID NO: 13550 - DNA, 25 bp, Homo sapiens
gcagctgcagctggaggaagccaag

SEQ ID NO: 13551 - DNA, 25 bp, Homo sapiens
cagctgcagctggaggaagccaaga

SEQ ID NO: 13552 - DNA, 25 bp, Homo sapiens
agctgcagctggaggaagccaagaa

SEQ ID NO: 13553 - DNA, 25 bp, Homo sapiens
gctgcagctggaggaagccaagaag

SEQ ID NO: 13554 - DNA, 25 bp, Homo sapiens
ctgcagctggaggaagccaagaagg

SEQ ID NO: 13555 - DNA, 25 bp, Homo sapiens
tgcagctggaggaagccaagaagga

SEQ ID NO: 13556 - DNA, 25 bp, Homo sapiens
gcagctggaggaagccaagaaggag

SEQ ID NO: 13557 - DNA, 25 bp, Homo sapiens
cagctggaggaagccaagaaggaga

SEQ ID NO: 13558 - DNA, 25 bp, Homo sapiens
agctggaggaagccaagaaggagaa

SEQ ID NO: 13559 - DNA, 25 bp, Homo sapiens
gctggaggaagccaagaaggagaag

SEQ ID NO: 13560 - DNA, 25 bp, Homo sapiens
ctggaggaagccaagaaggagaagc

SEQ ID NO: 13561 - DNA, 25 bp, Homo sapiens
tggaggaagccaagaaggagaagca

SEQ ID NO: 13562 - DNA, 25 bp, Homo sapiens
ggaggaagccaagaaggagaagcac

SEQ ID NO: 13563 - DNA, 25 bp, Homo sapiens
gaggaagccaagaaggagaagcaca

SEQ ID NO: 13564 - DNA, 25 bp, Homo sapiens
aggaagccaagaaggagaagcacaa

SEQ ID NO: 13565 - DNA, 25 bp, Homo sapiens
ggaagccaagaaggagaagcacaag

SEQ ID NO: 13566 - DNA, 25 bp, Homo sapiens
gaagccaagaaggagaagcacaagc

SEQ ID NO: 13567 - DNA, 25 bp, Homo sapiens
aagccaagaaggagaagcacaagct

SEQ ID NO: 13568 - DNA, 25 bp, Homo sapiens
agccaagaaggagaagcacaagcta

SEQ ID NO: 13569 - DNA, 25 bp, Homo sapiens
gccaagaaggagaagcacaagctac

SEQ ID NO: 13570 - DNA, 25 bp, Homo sapiens
ccaagaaggagaagcacaagctaca

SEQ ID NO: 13571 - DNA, 25 bp, Homo sapiens
caagaaggagaagcacaagctacaa

SEQ ID NO: 13572 - DNA, 25 bp, Homo sapiens
aagaaggagaagcacaagctacaag

SEQ ID NO: 13573 - DNA, 25 bp, Homo sapiens
agaaggagaagcacaagctacaaga

SEQ ID NO: 13574 - DNA, 25 bp, Homo sapiens
gaaggagaagcacaagctacaagaa

SEQ ID NO: 13575 - DNA, 25 bp, Homo sapiens
aaggagaagcacaagctacaagaac

SEQ ID NO: 13576 - DNA, 25 bp, Homo sapiens
aggagaagcacaagctacaagaaca

SEQ ID NO: 13577 - DNA, 25 bp, Homo sapiens
ggagaagcacaagctacaagaacaa

SEQ ID NO: 13578 - DNA, 25 bp, Homo sapiens
gagaagcacaagctacaagaacaac

SEQ ID NO: 13579 - DNA, 25 bp, Homo sapiens
agaagcacaagctacaagaacaact

SEQ ID NO: 13580 - DNA, 25 bp, Homo sapiens
gaagcacaagctacaagaacaactg

SEQ ID NO: 13581 - DNA, 25 bp, Homo sapiens
aagcacaagctacaagaacaactgc

SEQ ID NO: 13582 - DNA, 25 bp, Homo sapiens
agcacaagctacaagaacaactgca

SEQ ID NO: 13583 - DNA, 25 bp, Homo sapiens
gcacaagctacaagaacaactgcag

SEQ ID NO: 13584 - DNA, 25 bp, Homo sapiens
cacaagctacaagaacaactgcagg

SEQ ID NO: 13585 - DNA, 25 bp, Homo sapiens
acaagctacaagaacaactgcaggt

SEQ ID NO: 13586 - DNA, 25 bp, Homo sapiens
caagctacaagaacaactgcaggtg

SEQ ID NO: 13587 - DNA, 25 bp, Homo sapiens
aagctacaagaacaactgcaggtgg

SEQ ID NO: 13588 - DNA, 25 bp, Homo sapiens
agctacaagaacaactgcaggtggc

SEQ ID NO: 13589 - DNA, 25 bp, Homo sapiens
gctacaagaacaactgcaggtggct

SEQ ID NO: 13590 - DNA, 25 bp, Homo sapiens
ctacaagaacaactgcaggtggctc

SEQ ID NO: 13591 - DNA, 25 bp, Homo sapiens
tacaagaacaactgcaggtggctca

SEQ ID NO: 13592 - DNA, 25 bp, Homo sapiens
acaagaacaactgcaggtggctcag

SEQ ID NO: 13593 - DNA, 25 bp, Homo sapiens
caagaacaactgcaggtggctcaga

SEQ ID NO: 13594 - DNA, 25 bp, Homo sapiens
aagaacaactgcaggtggctcagat

SEQ ID NO: 13595 - DNA, 25 bp, Homo sapiens
agaacaactgcaggtggctcagatg

SEQ ID NO: 13596 - DNA, 25 bp, Homo sapiens
gaacaactgcaggtggctcagatgc

SEQ ID NO: 13597 - DNA, 25 bp, Homo sapiens
aacaactgcaggtggctcagatgcg

SEQ ID NO: 13598 - DNA, 25 bp, Homo sapiens
acaactgcaggtggctcagatgcgc

SEQ ID NO: 13599 - DNA, 25 bp, Homo sapiens
caactgcaggtggctcagatgcgca

SEQ ID NO: 13600 - DNA, 25 bp, Homo sapiens
aactgcaggtggctcagatgcgcat

SEQ ID NO: 13601 - DNA, 25 bp, Homo sapiens
actgcaggtggctcagatgcgcatc

SEQ ID NO: 13602 - DNA, 25 bp, Homo sapiens
ctgcaggtggctcagatgcgcatcg

SEQ ID NO: 13603 - DNA, 25 bp, Homo sapiens
tgcaggtggctcagatgcgcatcga

SEQ ID NO: 13604 - DNA, 25 bp, Homo sapiens
gcaggtggctcagatgcgcatcgag

SEQ ID NO: 13605 - DNA, 25 bp, Homo sapiens
caggtggctcagatgcgcatcgagt

SEQ ID NO: 13606 - DNA, 25 bp, Homo sapiens
aggtggctcagatgcgcatcgagta

SEQ ID NO: 13607 - DNA, 25 bp, Homo sapiens
ggtggctcagatgcgcatcgagtac

SEQ ID NO: 13608 - DNA, 25 bp, Homo sapiens
gtggctcagatgcgcatcgagtacc

SEQ ID NO: 13609 - DNA, 25 bp, Homo sapiens
tggctcagatgcgcatcgagtacct

SEQ ID NO: 13610 - DNA, 25 bp, Homo sapiens
ggctcagatgcgcatcgagtacctg

SEQ ID NO: 13611 - DNA, 25 bp, Homo sapiens
gctcagatgcgcatcgagtacctgg

SEQ ID NO: 13612 - DNA, 25 bp, Homo sapiens
ctcagatgcgcatcgagtacctgga

SEQ ID NO: 13613 - DNA, 25 bp, Homo sapiens
tcagatgcgcatcgagtacctggaa

SEQ ID NO: 13614 - DNA, 25 bp, Homo sapiens
cagatgcgcatcgagtacctggaac

SEQ ID NO: 13615 - DNA, 25 bp, Homo sapiens
agatgcgcatcgagtacctggaaca

SEQ ID NO: 13616 - DNA, 25 bp, Homo sapiens
gatgcgcatcgagtacctggaacag

SEQ ID NO: 13617 - DNA, 25 bp, Homo sapiens
atgcgcatcgagtacctggaacagt

SEQ ID NO: 13618 - DNA, 25 bp, Homo sapiens
tgcgcatcgagtacctggaacagtc

SEQ ID NO: 13619 - DNA, 25 bp, Homo sapiens
gcgcatcgagtacctggaacagtcc

SEQ ID NO: 13620 - DNA, 25 bp, Homo sapiens
cgcatcgagtacctggaacagtcca

SEQ ID NO: 13621 - DNA, 25 bp, Homo sapiens
gcatcgagtacctggaacagtccac

SEQ ID NO: 13622 - DNA, 25 bp, Homo sapiens
catcgagtacctggaacagtccacc

SEQ ID NO: 13623 - DNA, 25 bp, Homo sapiens
atcgagtacctggaacagtccaccg

SEQ ID NO: 13624 - DNA, 25 bp, Homo sapiens
tcgagtacctggaacagtccaccgt

SEQ ID NO: 13625 - DNA, 25 bp, Homo sapiens
cgagtacctggaacagtccaccgtg

SEQ ID NO: 13626 - DNA, 25 bp, Homo sapiens
gagtacctggaacagtccaccgtgg

SEQ ID NO: 13627 - DNA, 25 bp, Homo sapiens
agtacctggaacagtccaccgtgga

SEQ ID NO: 13628 - DNA, 25 bp, Homo sapiens
gtacctggaacagtccaccgtggat

SEQ ID NO: 13629 - DNA, 25 bp, Homo sapiens
tacctggaacagtccaccgtggatc

SEQ ID NO: 13630 - DNA, 25 bp, Homo sapiens
acctggaacagtccaccgtggatcg

SEQ ID NO: 13631 - DNA, 25 bp, Homo sapiens
cctggaacagtccaccgtggatcga

SEQ ID NO: 13632 - DNA, 25 bp, Homo sapiens
ctggaacagtccaccgtggatcgag

SEQ ID NO: 13633 - DNA, 25 bp, Homo sapiens
tggaacagtccaccgtggatcgagc

SEQ ID NO: 13634 - DNA, 25 bp, Homo sapiens
ggaacagtccaccgtggatcgagcc

SEQ ID NO: 13635 - DNA, 25 bp, Homo sapiens
gaacagtccaccgtggatcgagcca

SEQ ID NO: 13636 - DNA, 25 bp, Homo sapiens
aacagtccaccgtggatcgagccat

SEQ ID NO: 13637 - DNA, 25 bp, Homo sapiens
acagtccaccgtggatcgagccatc

SEQ ID NO: 13638 - DNA, 25 bp, Homo sapiens
cagtccaccgtggatcgagccatcg

SEQ ID NO: 13639 - DNA, 25 bp, Homo sapiens
agtccaccgtggatcgagccatcgt

SEQ ID NO: 13640 - DNA, 25 bp, Homo sapiens
gtccaccgtggatcgagccatcgtc

SEQ ID NO: 13641 - DNA, 25 bp, Homo sapiens
tccaccgtggatcgagccatcgtca

SEQ ID NO: 13642 - DNA, 25 bp, Homo sapiens
ccaccgtggatcgagccatcgtcag

SEQ ID NO: 13643 - DNA, 25 bp, Homo sapiens
caccgtggatcgagccatcgtcagc

SEQ ID NO: 13644 - DNA, 25 bp, Homo sapiens
accgtggatcgagccatcgtcagca

SEQ ID NO: 13645 - DNA, 25 bp, Homo sapiens
ccgtggatcgagccatcgtcagcag

SEQ ID NO: 13646 - DNA, 25 bp, Homo sapiens
cgtggatcgagccatcgtcagcagg

SEQ ID NO: 13647 - DNA, 25 bp, Homo sapiens
gtggatcgagccatcgtcagcaggc

SEQ ID NO: 13648 - DNA, 25 bp, Homo sapiens
tggatcgagccatcgtcagcaggca

SEQ ID NO: 13649 - DNA, 25 bp, Homo sapiens
ggatcgagccatcgtcagcaggcag

SEQ ID NO: 13650 - DNA, 25 bp, Homo sapiens
gatcgagccatcgtcagcaggcagg

SEQ ID NO: 13651 - DNA, 25 bp, Homo sapiens
atcgagccatcgtcagcaggcagga

SEQ ID NO: 13652 - DNA, 25 bp, Homo sapiens
tcgagccatcgtcagcaggcaggag

SEQ ID NO: 13653 - DNA, 25 bp, Homo sapiens
cgagccatcgtcagcaggcaggagg

SEQ ID NO: 13654 - DNA, 25 bp, Homo sapiens
gagccatcgtcagcaggcaggaggc

SEQ ID NO: 13655 - DNA, 25 bp, Homo sapiens
agccatcgtcagcaggcaggaggcg

SEQ ID NO: 13656 - DNA, 25 bp, Homo sapiens
gccatcgtcagcaggcaggaggcgg

SEQ ID NO: 13657 - DNA, 25 bp, Homo sapiens
ccatcgtcagcaggcaggaggcggt

SEQ ID NO: 13658 - DNA, 25 bp, Homo sapiens
catcgtcagcaggcaggaggcggtc

SEQ ID NO: 13659 - DNA, 25 bp, Homo sapiens
atcgtcagcaggcaggaggcggtca

SEQ ID NO: 13660 - DNA, 25 bp, Homo sapiens
tcgtcagcaggcaggaggcggtcat

SEQ ID NO: 13661 - DNA, 25 bp, Homo sapiens
cgtcagcaggcaggaggcggtcatc

SEQ ID NO: 13662 - DNA, 25 bp, Homo sapiens
gtcagcaggcaggaggcggtcatct

SEQ ID NO: 13663 - DNA, 25 bp, Homo sapiens
tcagcaggcaggaggcggtcatctg

SEQ ID NO: 13664 - DNA, 25 bp, Homo sapiens
cagcaggcaggaggcggtcatctgt

SEQ ID NO: 13665 - DNA, 25 bp, Homo sapiens
agcaggcaggaggcggtcatctgtg

SEQ ID NO: 13666 - DNA, 25 bp, Homo sapiens
gcaggcaggaggcggtcatctgtga

SEQ ID NO: 13667 - DNA, 25 bp, Homo sapiens
caggcaggaggcggtcatctgtgac

SEQ ID NO: 13668 - DNA, 25 bp, Homo sapiens
aggcaggaggcggtcatctgtgacc

SEQ ID NO: 13669 - DNA, 25 bp, Homo sapiens
ggcaggaggcggtcatctgtgacct

SEQ ID NO: 13670 - DNA, 25 bp, Homo sapiens
gcaggaggcggtcatctgtgaccta

SEQ ID NO: 13671 - DNA, 25 bp, Homo sapiens
caggaggcggtcatctgtgacctag

SEQ ID NO: 13672 - DNA, 25 bp, Homo sapiens
aggaggcggtcatctgtgacctaga

SEQ ID NO: 13673 - DNA, 25 bp, Homo sapiens
ggaggcggtcatctgtgacctagag

SEQ ID NO: 13674 - DNA, 25 bp, Homo sapiens
gaggcggtcatctgtgacctagaga

SEQ ID NO: 13675 - DNA, 25 bp, Homo sapiens
aggcggtcatctgtgacctagagaa

SEQ ID NO: 13676 - DNA, 25 bp, Homo sapiens
ggcggtcatctgtgacctagagaac

SEQ ID NO: 13677 - DNA, 25 bp, Homo sapiens
gcggtcatctgtgacctagagaaca

SEQ ID NO: 13678 - DNA, 25 bp, Homo sapiens
cggtcatctgtgacctagagaacaa

SEQ ID NO: 13679 - DNA, 25 bp, Homo sapiens
ggtcatctgtgacctagagaacaag

SEQ ID NO: 13680 - DNA, 25 bp, Homo sapiens
gtcatctgtgacctagagaacaaga

SEQ ID NO: 13681 - DNA, 25 bp, Homo sapiens
tcatctgtgacctagagaacaagac

SEQ ID NO: 13682 - DNA, 25 bp, Homo sapiens
catctgtgacctagagaacaagaca

SEQ ID NO: 13683 - DNA, 25 bp, Homo sapiens
atctgtgacctagagaacaagacag

SEQ ID NO: 13684 - DNA, 25 bp, Homo sapiens
tctgtgacctagagaacaagacaga

SEQ ID NO: 13685 - DNA, 25 bp, Homo sapiens
ctgtgacctagagaacaagacagag

SEQ ID NO: 13686 - DNA, 25 bp, Homo sapiens
tgtgacctagagaacaagacagagt

SEQ ID NO: 13687 - DNA, 25 bp, Homo sapiens
gtgacctagagaacaagacagagtt

SEQ ID NO: 13688 - DNA, 25 bp, Homo sapiens
tgacctagagaacaagacagagttc

SEQ ID NO: 13689 - DNA, 25 bp, Homo sapiens
gacctagagaacaagacagagttcc

SEQ ID NO: 13690 - DNA, 25 bp, Homo sapiens
acctagagaacaagacagagttcca

SEQ ID NO: 13691 - DNA, 25 bp, Homo sapiens
cctagagaacaagacagagttccag

SEQ ID NO: 13692 - DNA, 25 bp, Homo sapiens
ctagagaacaagacagagttccaga

SEQ ID NO: 13693 - DNA, 25 bp, Homo sapiens
tagagaacaagacagagttccagaa

SEQ ID NO: 13694 - DNA, 25 bp, Homo sapiens
agagaacaagacagagttccagaag

SEQ ID NO: 13695 - DNA, 25 bp, Homo sapiens
gagaacaagacagagttccagaagg

SEQ ID NO: 13696 - DNA, 25 bp, Homo sapiens
agaacaagacagagttccagaaggt

SEQ ID NO: 13697 - DNA, 25 bp, Homo sapiens
gaacaagacagagttccagaaggtg

SEQ ID NO: 13698 - DNA, 25 bp, Homo sapiens
aacaagacagagttccagaaggtgc

SEQ ID NO: 13699 - DNA, 25 bp, Homo sapiens
acaagacagagttccagaaggtgca

SEQ ID NO: 13700 - DNA, 25 bp, Homo sapiens
caagacagagttccagaaggtgcag

SEQ ID NO: 13701 - DNA, 25 bp, Homo sapiens
aagacagagttccagaaggtgcaga

SEQ ID NO: 13702 - DNA, 25 bp, Homo sapiens
agacagagttccagaaggtgcagat

SEQ ID NO: 13703 - DNA, 25 bp, Homo sapiens
gacagagttccagaaggtgcagatt

SEQ ID NO: 13704 - DNA, 25 bp, Homo sapiens
acagagttccagaaggtgcagatta

SEQ ID NO: 13705 - DNA, 25 bp, Homo sapiens
cagagttccagaaggtgcagattaa

SEQ ID NO: 13706 - DNA, 25 bp, Homo sapiens
agagttccagaaggtgcagattaag

SEQ ID NO: 13707 - DNA, 25 bp, Homo sapiens
gagttccagaaggtgcagattaaga

SEQ ID NO: 13708 - DNA, 25 bp, Homo sapiens
agttccagaaggtgcagattaagag

SEQ ID NO: 13709 - DNA, 25 bp, Homo sapiens
gttccagaaggtgcagattaagaga

SEQ ID NO: 13710 - DNA, 25 bp, Homo sapiens
ttccagaaggtgcagattaagagat

SEQ ID NO: 13711 - DNA, 25 bp, Homo sapiens
tccagaaggtgcagattaagagatt

SEQ ID NO: 13712 - DNA, 25 bp, Homo sapiens
ccagaaggtgcagattaagagattt

SEQ ID NO: 13713 - DNA, 25 bp, Homo sapiens
cagaaggtgcagattaagagatttg

SEQ ID NO: 13714 - DNA, 25 bp, Homo sapiens
agaaggtgcagattaagagatttga

SEQ ID NO: 13715 - DNA, 25 bp, Homo sapiens
gaaggtgcagattaagagatttgag

SEQ ID NO: 13716 - DNA, 25 bp, Homo sapiens
aaggtgcagattaagagatttgagg

SEQ ID NO: 13717 - DNA, 25 bp, Homo sapiens
aggtgcagattaagagatttgaggt

SEQ ID NO: 13718 - DNA, 25 bp, Homo sapiens
ggtgcagattaagagatttgaggtc

SEQ ID NO: 13719 - DNA, 25 bp, Homo sapiens
gtgcagattaagagatttgaggtcc

SEQ ID NO: 13720 - DNA, 25 bp, Homo sapiens
tgcagattaagagatttgaggtcct

SEQ ID NO: 13721 - DNA, 25 bp, Homo sapiens
gcagattaagagatttgaggtcctg

SEQ ID NO: 13722 - DNA, 25 bp, Homo sapiens
cagattaagagatttgaggtcctgg

SEQ ID NO: 13723 - DNA, 25 bp, Homo sapiens
agattaagagatttgaggtcctggt

SEQ ID NO: 13724 - DNA, 25 bp, Homo sapiens
gattaagagatttgaggtcctggtg

SEQ ID NO: 13725 - DNA, 25 bp, Homo sapiens
attaagagatttgaggtcctggtga

SEQ ID NO: 13726 - DNA, 25 bp, Homo sapiens
ttaagagatttgaggtcctggtgat

SEQ ID NO: 13727 - DNA, 25 bp, Homo sapiens
taagagatttgaggtcctggtgatc

SEQ ID NO: 13728 - DNA, 25 bp, Homo sapiens
aagagatttgaggtcctggtgatcc

SEQ ID NO: 13729 - DNA, 25 bp, Homo sapiens
agagatttgaggtcctggtgatccg

SEQ ID NO: 13730 - DNA, 25 bp, Homo sapiens
gagatttgaggtcctggtgatccgg

SEQ ID NO: 13731 - DNA, 25 bp, Homo sapiens
agatttgaggtcctggtgatccggc

SEQ ID NO: 13732 - DNA, 25 bp, Homo sapiens
gatttgaggtcctggtgatccggct

SEQ ID NO: 13733 - DNA, 25 bp, Homo sapiens
atttgaggtcctggtgatccggctt

SEQ ID NO: 13734 - DNA, 25 bp, Homo sapiens
tttgaggtcctggtgatccggcttc

SEQ ID NO: 13735 - DNA, 25 bp, Homo sapiens
ttgaggtcctggtgatccggcttcg

SEQ ID NO: 13736 - DNA, 25 bp, Homo sapiens
tgaggtcctggtgatccggcttcgg

SEQ ID NO: 13737 - DNA, 25 bp, Homo sapiens
gaggtcctggtgatccggcttcggg

SEQ ID NO: 13738 - DNA, 25 bp, Homo sapiens
aggtcctggtgatccggcttcggga

SEQ ID NO: 13739 - DNA, 25 bp, Homo sapiens
ggtcctggtgatccggcttcgggac

SEQ ID NO: 13740 - DNA, 25 bp, Homo sapiens
gtcctggtgatccggcttcgggaca

SEQ ID NO: 13741 - DNA, 25 bp, Homo sapiens
tcctggtgatccggcttcgggacag

SEQ ID NO: 13742 - DNA, 25 bp, Homo sapiens
cctggtgatccggcttcgggacagc

SEQ ID NO: 13743 - DNA, 25 bp, Homo sapiens
ctggtgatccggcttcgggacagcc

SEQ ID NO: 13744 - DNA, 25 bp, Homo sapiens
tggtgatccggcttcgggacagcct

SEQ ID NO: 13745 - DNA, 25 bp, Homo sapiens
ggtgatccggcttcgggacagcctg

SEQ ID NO: 13746 - DNA, 25 bp, Homo sapiens
gtgatccggcttcgggacagcctga

SEQ ID NO: 13747 - DNA, 25 bp, Homo sapiens
tgatccggcttcgggacagcctgat

SEQ ID NO: 13748 - DNA, 25 bp, Homo sapiens
gatccggcttcgggacagcctgatc

SEQ ID NO: 13749 - DNA, 25 bp, Homo sapiens
atccggcttcgggacagcctgatca

SEQ ID NO: 13750 - DNA, 25 bp, Homo sapiens
tccggcttcgggacagcctgatcaa

SEQ ID NO: 13751 - DNA, 25 bp, Homo sapiens
ccggcttcgggacagcctgatcaag

SEQ ID NO: 13752 - DNA, 25 bp, Homo sapiens
cggcttcgggacagcctgatcaaga

SEQ ID NO: 13753 - DNA, 25 bp, Homo sapiens
ggcttcgggacagcctgatcaagat

SEQ ID NO: 13754 - DNA, 25 bp, Homo sapiens
gcttcgggacagcctgatcaagatg

SEQ ID NO: 13755 - DNA, 25 bp, Homo sapiens
cttcgggacagcctgatcaagatgg

SEQ ID NO: 13756 - DNA, 25 bp, Homo sapiens
ttcgggacagcctgatcaagatggg

SEQ ID NO: 13757 - DNA, 25 bp, Homo sapiens
tcgggacagcctgatcaagatgggg

SEQ ID NO: 13758 - DNA, 25 bp, Homo sapiens
cgggacagcctgatcaagatggggg

SEQ ID NO: 13759 - DNA, 25 bp, Homo sapiens
gggacagcctgatcaagatggggga

SEQ ID NO: 13760 - DNA, 25 bp, Homo sapiens
ggacagcctgatcaagatgggggag

SEQ ID NO: 13761 - DNA, 25 bp, Homo sapiens
gacagcctgatcaagatgggggagg

SEQ ID NO: 13762 - DNA, 25 bp, Homo sapiens
acagcctgatcaagatgggggagga

SEQ ID NO: 13763 - DNA, 25 bp, Homo sapiens
cagcctgatcaagatgggggaggag

SEQ ID NO: 13764 - DNA, 25 bp, Homo sapiens
agcctgatcaagatgggggaggagc

SEQ ID NO: 13765 - DNA, 25 bp, Homo sapiens
gcctgatcaagatgggggaggagct

SEQ ID NO: 13766 - DNA, 25 bp, Homo sapiens
cctgatcaagatgggggaggagctt

SEQ ID NO: 13767 - DNA, 25 bp, Homo sapiens
ctgatcaagatgggggaggagcttt

SEQ ID NO: 13768 - DNA, 25 bp, Homo sapiens
tgatcaagatgggggaggagctttc

SEQ ID NO: 13769 - DNA, 25 bp, Homo sapiens
gatcaagatgggggaggagctttca

SEQ ID NO: 13770 - DNA, 25 bp, Homo sapiens
atcaagatgggggaggagctttcac

SEQ ID NO: 13771 - DNA, 25 bp, Homo sapiens
tcaagatgggggaggagctttcaca

SEQ ID NO: 13772 - DNA, 25 bp, Homo sapiens
caagatgggggaggagctttcacag

SEQ ID NO: 13773 - DNA, 25 bp, Homo sapiens
aagatgggggaggagctttcacagg

SEQ ID NO: 13774 - DNA, 25 bp, Homo sapiens
agatgggggaggagctttcacaggc

SEQ ID NO: 13775 - DNA, 25 bp, Homo sapiens
gatgggggaggagctttcacaggcg

SEQ ID NO: 13776 - DNA, 25 bp, Homo sapiens
atgggggaggagctttcacaggcgg

SEQ ID NO: 13777 - DNA, 25 bp, Homo sapiens
tgggggaggagctttcacaggcggc

SEQ ID NO: 13778 - DNA, 25 bp, Homo sapiens
gggggaggagctttcacaggcggcc

SEQ ID NO: 13779 - DNA, 25 bp, Homo sapiens
ggggaggagctttcacaggcggcca

SEQ ID NO: 13780 - DNA, 25 bp, Homo sapiens
gggaggagctttcacaggcggccac

SEQ ID NO: 13781 - DNA, 25 bp, Homo sapiens
ggaggagctttcacaggcggccacc

SEQ ID NO: 13782 - DNA, 25 bp, Homo sapiens
gaggagctttcacaggcggccacct

SEQ ID NO: 13783 - DNA, 25 bp, Homo sapiens
aggagctttcacaggcggccacctc

SEQ ID NO: 13784 - DNA, 25 bp, Homo sapiens
ggagctttcacaggcggccacctcc

SEQ ID NO: 13785 - DNA, 25 bp, Homo sapiens
gagctttcacaggcggccacctccg

SEQ ID NO: 13786 - DNA, 25 bp, Homo sapiens
agctttcacaggcggccacctccga

SEQ ID NO: 13787 - DNA, 25 bp, Homo sapiens
gctttcacaggcggccacctccgag

SEQ ID NO: 13788 - DNA, 25 bp, Homo sapiens
ctttcacaggcggccacctccgagt

SEQ ID NO: 13789 - DNA, 25 bp, Homo sapiens
tttcacaggcggccacctccgagtc

SEQ ID NO: 13790 - DNA, 25 bp, Homo sapiens
ttcacaggcggccacctccgagtcc

SEQ ID NO: 13791 - DNA, 25 bp, Homo sapiens
tcacaggcggccacctccgagtccc

SEQ ID NO: 13792 - DNA, 25 bp, Homo sapiens
cacaggcggccacctccgagtccca

SEQ ID NO: 13793 - DNA, 25 bp, Homo sapiens
acaggcggccacctccgagtcccag

SEQ ID NO: 13794 - DNA, 25 bp, Homo sapiens
caggcggccacctccgagtcccagc

SEQ ID NO: 13795 - DNA, 25 bp, Homo sapiens
aggcggccacctccgagtcccagca

SEQ ID NO: 13796 - DNA, 25 bp, Homo sapiens
ggcggccacctccgagtcccagcag

SEQ ID NO: 13797 - DNA, 25 bp, Homo sapiens
gcggccacctccgagtcccagcagc

SEQ ID NO: 13798 - DNA, 25 bp, Homo sapiens
cggccacctccgagtcccagcagcg

SEQ ID NO: 13799 - DNA, 25 bp, Homo sapiens
ggccacctccgagtcccagcagcgg

SEQ ID NO: 13800 - DNA, 25 bp, Homo sapiens
gccacctccgagtcccagcagcggg

SEQ ID NO: 13801 - DNA, 25 bp, Homo sapiens
ccacctccgagtcccagcagcggga

SEQ ID NO: 13802 - DNA, 25 bp, Homo sapiens
cacctccgagtcccagcagcgggag

SEQ ID NO: 13803 - DNA, 25 bp, Homo sapiens
acctccgagtcccagcagcgggaga

SEQ ID NO: 13804 - DNA, 25 bp, Homo sapiens
cctccgagtcccagcagcgggagag

SEQ ID NO: 13805 - DNA, 25 bp, Homo sapiens
ctccgagtcccagcagcgggagagc

SEQ ID NO: 13806 - DNA, 25 bp, Homo sapiens
tccgagtcccagcagcgggagagca

SEQ ID NO: 13807 - DNA, 25 bp, Homo sapiens
ccgagtcccagcagcgggagagcag

SEQ ID NO: 13808 - DNA, 25 bp, Homo sapiens
cgagtcccagcagcgggagagcagc

SEQ ID NO: 13809 - DNA, 25 bp, Homo sapiens
gagtcccagcagcgggagagcagcc

SEQ ID NO: 13810 - DNA, 25 bp, Homo sapiens
agtcccagcagcgggagagcagcca

SEQ ID NO: 13811 - DNA, 25 bp, Homo sapiens
gtcccagcagcgggagagcagccag

SEQ ID NO: 13812 - DNA, 25 bp, Homo sapiens
tcccagcagcgggagagcagccagt

SEQ ID NO: 13813 - DNA, 25 bp, Homo sapiens
cccagcagcgggagagcagccagta

SEQ ID NO: 13814 - DNA, 25 bp, Homo sapiens
ccagcagcgggagagcagccagtac

SEQ ID NO: 13815 - DNA, 25 bp, Homo sapiens
cagcagcgggagagcagccagtact

SEQ ID NO: 13816 - DNA, 25 bp, Homo sapiens
agcagcgggagagcagccagtacta

SEQ ID NO: 13817 - DNA, 25 bp, Homo sapiens
gcagcgggagagcagccagtactac

SEQ ID NO: 13818 - DNA, 25 bp, Homo sapiens
cagcgggagagcagccagtactacc

SEQ ID NO: 13819 - DNA, 25 bp, Homo sapiens
agcgggagagcagccagtactacca

SEQ ID NO: 13820 - DNA, 25 bp, Homo sapiens
gcgggagagcagccagtactaccag

SEQ ID NO: 13821 - DNA, 25 bp, Homo sapiens
cgggagagcagccagtactaccagc

SEQ ID NO: 13822 - DNA, 25 bp, Homo sapiens
gggagagcagccagtactaccagcg

SEQ ID NO: 13823 - DNA, 25 bp, Homo sapiens
ggagagcagccagtactaccagcgg

SEQ ID NO: 13824 - DNA, 25 bp, Homo sapiens
gagagcagccagtactaccagcggc

SEQ ID NO: 13825 - DNA, 25 bp, Homo sapiens
agagcagccagtactaccagcggcg

SEQ ID NO: 13826 - DNA, 25 bp, Homo sapiens
gagcagccagtactaccagcggcgc

SEQ ID NO: 13827 - DNA, 25 bp, Homo sapiens
agcagccagtactaccagcggcgcc

SEQ ID NO: 13828 - DNA, 25 bp, Homo sapiens
gcagccagtactaccagcggcgcct

SEQ ID NO: 13829 - DNA, 25 bp, Homo sapiens
cagccagtactaccagcggcgcctg

SEQ ID NO: 13830 - DNA, 25 bp, Homo sapiens
agccagtactaccagcggcgcctgg

SEQ ID NO: 13831 - DNA, 25 bp, Homo sapiens
gccagtactaccagcggcgcctgga

SEQ ID NO: 13832 - DNA, 25 bp, Homo sapiens
ccagtactaccagcggcgcctggaa

SEQ ID NO: 13833 - DNA, 25 bp, Homo sapiens
cagtactaccagcggcgcctggaag

SEQ ID NO: 13834 - DNA, 25 bp, Homo sapiens
agtactaccagcggcgcctggaaga

SEQ ID NO: 13835 - DNA, 25 bp, Homo sapiens
gtactaccagcggcgcctggaagag

SEQ ID NO: 13836 - DNA, 25 bp, Homo sapiens
tactaccagcggcgcctggaagagc

SEQ ID NO: 13837 - DNA, 25 bp, Homo sapiens
actaccagcggcgcctggaagagct

SEQ ID NO: 13838 - DNA, 25 bp, Homo sapiens
ctaccagcggcgcctggaagagctg

SEQ ID NO: 13839 - DNA, 25 bp, Homo sapiens
taccagcggcgcctggaagagctga

SEQ ID NO: 13840 - DNA, 25 bp, Homo sapiens
accagcggcgcctggaagagctgaa

SEQ ID NO: 13841 - DNA, 25 bp, Homo sapiens
ccagcggcgcctggaagagctgaag

SEQ ID NO: 13842 - DNA, 25 bp, Homo sapiens
cagcggcgcctggaagagctgaagg

SEQ ID NO: 13843 - DNA, 25 bp, Homo sapiens
agcggcgcctggaagagctgaaggc

SEQ ID NO: 13844 - DNA, 25 bp, Homo sapiens
gcggcgcctggaagagctgaaggcc

SEQ ID NO: 13845 - DNA, 25 bp, Homo sapiens
cggcgcctggaagagctgaaggccg

SEQ ID NO: 13846 - DNA, 25 bp, Homo sapiens
ggcgcctggaagagctgaaggccga

SEQ ID NO: 13847 - DNA, 25 bp, Homo sapiens
gcgcctggaagagctgaaggccgac

SEQ ID NO: 13848 - DNA, 25 bp, Homo sapiens
cgcctggaagagctgaaggccgaca

SEQ ID NO: 13849 - DNA, 25 bp, Homo sapiens
gcctggaagagctgaaggccgacat

SEQ ID NO: 13850 - DNA, 25 bp, Homo sapiens
cctggaagagctgaaggccgacatg

SEQ ID NO: 13851 - DNA, 25 bp, Homo sapiens
ctggaagagctgaaggccgacatgg

SEQ ID NO: 13852 - DNA, 25 bp, Homo sapiens
tggaagagctgaaggccgacatgga

SEQ ID NO: 13853 - DNA, 25 bp, Homo sapiens
ggaagagctgaaggccgacatggaa

SEQ ID NO: 13854 - DNA, 25 bp, Homo sapiens
gaagagctgaaggccgacatggaag

SEQ ID NO: 13855 - DNA, 25 bp, Homo sapiens
aagagctgaaggccgacatggaaga

SEQ ID NO: 13856 - DNA, 25 bp, Homo sapiens
agagctgaaggccgacatggaagag

SEQ ID NO: 13857 - DNA, 25 bp, Homo sapiens
gagctgaaggccgacatggaagagc

SEQ ID NO: 13858 - DNA, 25 bp, Homo sapiens
agctgaaggccgacatggaagagct

SEQ ID NO: 13859 - DNA, 25 bp, Homo sapiens
gctgaaggccgacatggaagagctg

SEQ ID NO: 13860 - DNA, 25 bp, Homo sapiens
ctgaaggccgacatggaagagctgg

SEQ ID NO: 13861 - DNA, 25 bp, Homo sapiens
tgaaggccgacatggaagagctggt

SEQ ID NO: 13862 - DNA, 25 bp, Homo sapiens
gaaggccgacatggaagagctggtg

SEQ ID NO: 13863 - DNA, 25 bp, Homo sapiens
aaggccgacatggaagagctggtgc

SEQ ID NO: 13864 - DNA, 25 bp, Homo sapiens
aggccgacatggaagagctggtgca

SEQ ID NO: 13865 - DNA, 25 bp, Homo sapiens
ggccgacatggaagagctggtgcag

SEQ ID NO: 13866 - DNA, 25 bp, Homo sapiens
gccgacatggaagagctggtgcagc

SEQ ID NO: 13867 - DNA, 25 bp, Homo sapiens
ccgacatggaagagctggtgcagcg

SEQ ID NO: 13868 - DNA, 25 bp, Homo sapiens
cgacatggaagagctggtgcagcgg

SEQ ID NO: 13869 - DNA, 25 bp, Homo sapiens
gacatggaagagctggtgcagcggg

SEQ ID NO: 13870 - DNA, 25 bp, Homo sapiens
acatggaagagctggtgcagcggga

SEQ ID NO: 13871 - DNA, 25 bp, Homo sapiens
catggaagagctggtgcagcgggag

SEQ ID NO: 13872 - DNA, 25 bp, Homo sapiens
atggaagagctggtgcagcgggagg

SEQ ID NO: 13873 - DNA, 25 bp, Homo sapiens
tggaagagctggtgcagcgggaggc

SEQ ID NO: 13874 - DNA, 25 bp, Homo sapiens
ggaagagctggtgcagcgggaggca

SEQ ID NO: 13875 - DNA, 25 bp, Homo sapiens
gaagagctggtgcagcgggaggcag

SEQ ID NO: 13876 - DNA, 25 bp, Homo sapiens
aagagctggtgcagcgggaggcaga

SEQ ID NO: 13877 - DNA, 25 bp, Homo sapiens
agagctggtgcagcgggaggcagag

SEQ ID NO: 13878 - DNA, 25 bp, Homo sapiens
gagctggtgcagcgggaggcagagg

SEQ ID NO: 13879 - DNA, 25 bp, Homo sapiens
agctggtgcagcgggaggcagaggc

SEQ ID NO: 13880 - DNA, 25 bp, Homo sapiens
gctggtgcagcgggaggcagaggcc

SEQ ID NO: 13881 - DNA, 25 bp, Homo sapiens
ctggtgcagcgggaggcagaggcca

SEQ ID NO: 13882 - DNA, 25 bp, Homo sapiens
tggtgcagcgggaggcagaggccag

SEQ ID NO: 13883 - DNA, 25 bp, Homo sapiens
ggtgcagcgggaggcagaggccagc

SEQ ID NO: 13884 - DNA, 25 bp, Homo sapiens
gtgcagcgggaggcagaggccagcc

SEQ ID NO: 13885 - DNA, 25 bp, Homo sapiens
tgcagcgggaggcagaggccagccg

SEQ ID NO: 13886 - DNA, 25 bp, Homo sapiens
gcagcgggaggcagaggccagccgg

SEQ ID NO: 13887 - DNA, 25 bp, Homo sapiens
cagcgggaggcagaggccagccggc

SEQ ID NO: 13888 - DNA, 25 bp, Homo sapiens
agcgggaggcagaggccagccggcg

SEQ ID NO: 13889 - DNA, 25 bp, Homo sapiens
gcgggaggcagaggccagccggcgg

SEQ ID NO: 13890 - DNA, 25 bp, Homo sapiens
cgggaggcagaggccagccggcggt

SEQ ID NO: 13891 - DNA, 25 bp, Homo sapiens
gggaggcagaggccagccggcggtg

SEQ ID NO: 13892 - DNA, 25 bp, Homo sapiens
ggaggcagaggccagccggcggtgc

SEQ ID NO: 13893 - DNA, 25 bp, Homo sapiens
gaggcagaggccagccggcggtgca

SEQ ID NO: 13894 - DNA, 25 bp, Homo sapiens
aggcagaggccagccggcggtgcat

SEQ ID NO: 13895 - DNA, 25 bp, Homo sapiens
ggcagaggccagccggcggtgcatg

SEQ ID NO: 13896 - DNA, 25 bp, Homo sapiens
gcagaggccagccggcggtgcatgg

SEQ ID NO: 13897 - DNA, 25 bp, Homo sapiens
cagaggccagccggcggtgcatgga

SEQ ID NO: 13898 - DNA, 25 bp, Homo sapiens
agaggccagccggcggtgcatggag

SEQ ID NO: 13899 - DNA, 25 bp, Homo sapiens
gaggccagccggcggtgcatggagc

SEQ ID NO: 13900 - DNA, 25 bp, Homo sapiens
aggccagccggcggtgcatggagct

SEQ ID NO: 13901 - DNA, 25 bp, Homo sapiens
ggccagccggcggtgcatggagctg

SEQ ID NO: 13902 - DNA, 25 bp, Homo sapiens
gccagccggcggtgcatggagctgg

SEQ ID NO: 13903 - DNA, 25 bp, Homo sapiens
ccagccggcggtgcatggagctgga

SEQ ID NO: 13904 - DNA, 25 bp, Homo sapiens
cagccggcggtgcatggagctggag

SEQ ID NO: 13905 - DNA, 25 bp, Homo sapiens
agccggcggtgcatggagctggaga

SEQ ID NO: 13906 - DNA, 25 bp, Homo sapiens
gccggcggtgcatggagctggagaa

SEQ ID NO: 13907 - DNA, 25 bp, Homo sapiens
ccggcggtgcatggagctggagaag

SEQ ID NO: 13908 - DNA, 25 bp, Homo sapiens
cggcggtgcatggagctggagaagt

SEQ ID NO: 13909 - DNA, 25 bp, Homo sapiens
ggcggtgcatggagctggagaagta

SEQ ID NO: 13910 - DNA, 25 bp, Homo sapiens
gcggtgcatggagctggagaagtac

SEQ ID NO: 13911 - DNA, 25 bp, Homo sapiens
cggtgcatggagctggagaagtacg

SEQ ID NO: 13912 - DNA, 25 bp, Homo sapiens
ggtgcatggagctggagaagtacgt

SEQ ID NO: 13913 - DNA, 25 bp, Homo sapiens
gtgcatggagctggagaagtacgtg

SEQ ID NO: 13914 - DNA, 25 bp, Homo sapiens
tgcatggagctggagaagtacgtgg

SEQ ID NO: 13915 - DNA, 25 bp, Homo sapiens
gcatggagctggagaagtacgtgga

SEQ ID NO: 13916 - DNA, 25 bp, Homo sapiens
catggagctggagaagtacgtggag

SEQ ID NO: 13917 - DNA, 25 bp, Homo sapiens
atggagctggagaagtacgtggagg

SEQ ID NO: 13918 - DNA, 25 bp, Homo sapiens
tggagctggagaagtacgtggagga

SEQ ID NO: 13919 - DNA, 25 bp, Homo sapiens
ggagctggagaagtacgtggaggaa

SEQ ID NO: 13920 - DNA, 25 bp, Homo sapiens
gagctggagaagtacgtggaggaac

SEQ ID NO: 13921 - DNA, 25 bp, Homo sapiens
agctggagaagtacgtggaggaact

SEQ ID NO: 13922 - DNA, 25 bp, Homo sapiens
gctggagaagtacgtggaggaactt

SEQ ID NO: 13923 - DNA, 25 bp, Homo sapiens
ctggagaagtacgtggaggaacttg

SEQ ID NO: 13924 - DNA, 25 bp, Homo sapiens
tggagaagtacgtggaggaacttgc

SEQ ID NO: 13925 - DNA, 25 bp, Homo sapiens
ggagaagtacgtggaggaacttgca

SEQ ID NO: 13926 - DNA, 25 bp, Homo sapiens
gagaagtacgtggaggaacttgcag

SEQ ID NO: 13927 - DNA, 25 bp, Homo sapiens
agaagtacgtggaggaacttgcagc

SEQ ID NO: 13928 - DNA, 25 bp, Homo sapiens
gaagtacgtggaggaacttgcagca

SEQ ID NO: 13929 - DNA, 25 bp, Homo sapiens
aagtacgtggaggaacttgcagcag

SEQ ID NO: 13930 - DNA, 25 bp, Homo sapiens
agtacgtggaggaacttgcagcagt

SEQ ID NO: 13931 - DNA, 25 bp, Homo sapiens
gtacgtggaggaacttgcagcagtg

SEQ ID NO: 13932 - DNA, 25 bp, Homo sapiens
tacgtggaggaacttgcagcagtga

SEQ ID NO: 13933 - DNA, 25 bp, Homo sapiens
acgtggaggaacttgcagcagtgag

SEQ ID NO: 13934 - DNA, 25 bp, Homo sapiens
cgtggaggaacttgcagcagtgagg

SEQ ID NO: 13935 - DNA, 25 bp, Homo sapiens
gtggaggaacttgcagcagtgaggc

SEQ ID NO: 13936 - DNA, 25 bp, Homo sapiens
tggaggaacttgcagcagtgaggca

SEQ ID NO: 13937 - DNA, 25 bp, Homo sapiens
ggaggaacttgcagcagtgaggcaa

SEQ ID NO: 13938 - DNA, 25 bp, Homo sapiens
gaggaacttgcagcagtgaggcaaa

SEQ ID NO: 13939 - DNA, 25 bp, Homo sapiens
aggaacttgcagcagtgaggcaaac

SEQ ID NO: 13940 - DNA, 25 bp, Homo sapiens
ggaacttgcagcagtgaggcaaacc

SEQ ID NO: 13941 - DNA, 25 bp, Homo sapiens
gaacttgcagcagtgaggcaaaccc

SEQ ID NO: 13942 - DNA, 25 bp, Homo sapiens
aacttgcagcagtgaggcaaaccct

SEQ ID NO: 13943 - DNA, 25 bp, Homo sapiens
acttgcagcagtgaggcaaaccctc

SEQ ID NO: 13944 - DNA, 25 bp, Homo sapiens
cttgcagcagtgaggcaaaccctcc

SEQ ID NO: 13945 - DNA, 25 bp, Homo sapiens
ttgcagcagtgaggcaaaccctcca

SEQ ID NO: 13946 - DNA, 25 bp, Homo sapiens
tgcagcagtgaggcaaaccctccag

SEQ ID NO: 13947 - DNA, 25 bp, Homo sapiens
gcagcagtgaggcaaaccctccaga

SEQ ID NO: 13948 - DNA, 25 bp, Homo sapiens
cagcagtgaggcaaaccctccagac

SEQ ID NO: 13949 - DNA, 25 bp, Homo sapiens
agcagtgaggcaaaccctccagaca

SEQ ID NO: 13950 - DNA, 25 bp, Homo sapiens
gcagtgaggcaaaccctccagacag

SEQ ID NO: 13951 - DNA, 25 bp, Homo sapiens
cagtgaggcaaaccctccagacaga

SEQ ID NO: 13952 - DNA, 25 bp, Homo sapiens
agtgaggcaaaccctccagacagac

SEQ ID NO: 13953 - DNA, 25 bp, Homo sapiens
gtgaggcaaaccctccagacagacc

SEQ ID NO: 13954 - DNA, 25 bp, Homo sapiens
tgaggcaaaccctccagacagacct

SEQ ID NO: 13955 - DNA, 25 bp, Homo sapiens
gaggcaaaccctccagacagacctg

SEQ ID NO: 13956 - DNA, 25 bp, Homo sapiens
aggcaaaccctccagacagacctgg

SEQ ID NO: 13957 - DNA, 25 bp, Homo sapiens
ggcaaaccctccagacagacctgga

SEQ ID NO: 13958 - DNA, 25 bp, Homo sapiens
gcaaaccctccagacagacctggag

SEQ ID NO: 13959 - DNA, 25 bp, Homo sapiens
caaaccctccagacagacctggaga

SEQ ID NO: 13960 - DNA, 25 bp, Homo sapiens
aaaccctccagacagacctggagac

SEQ ID NO: 13961 - DNA, 25 bp, Homo sapiens
aaccctccagacagacctggagaca

SEQ ID NO: 13962 - DNA, 25 bp, Homo sapiens
accctccagacagacctggagacat

SEQ ID NO: 13963 - DNA, 25 bp, Homo sapiens
ccctccagacagacctggagacatc

SEQ ID NO: 13964 - DNA, 25 bp, Homo sapiens
cctccagacagacctggagacatcc

SEQ ID NO: 13965 - DNA, 25 bp, Homo sapiens
ctccagacagacctggagacatcca

SEQ ID NO: 13966 - DNA, 25 bp, Homo sapiens
tccagacagacctggagacatccat

SEQ ID NO: 13967 - DNA, 25 bp, Homo sapiens
ccagacagacctggagacatccatt

SEQ ID NO: 13968 - DNA, 25 bp, Homo sapiens
cagacagacctggagacatccattc

SEQ ID NO: 13969 - DNA, 25 bp, Homo sapiens
agacagacctggagacatccattcg

SEQ ID NO: 13970 - DNA, 25 bp, Homo sapiens
gacagacctggagacatccattcgg

SEQ ID NO: 13971 - DNA, 25 bp, Homo sapiens
acagacctggagacatccattcggc

SEQ ID NO: 13972 - DNA, 25 bp, Homo sapiens
cagacctggagacatccattcggcg

SEQ ID NO: 13973 - DNA, 25 bp, Homo sapiens
agacctggagacatccattcggcgg

SEQ ID NO: 13974 - DNA, 25 bp, Homo sapiens
gacctggagacatccattcggcgga

SEQ ID NO: 13975 - DNA, 25 bp, Homo sapiens
acctggagacatccattcggcggat

SEQ ID NO: 13976 - DNA, 25 bp, Homo sapiens
cctggagacatccattcggcggatt

SEQ ID NO: 13977 - DNA, 25 bp, Homo sapiens
ctggagacatccattcggcggattg

SEQ ID NO: 13978 - DNA, 25 bp, Homo sapiens
tggagacatccattcggcggattgc

SEQ ID NO: 13979 - DNA, 25 bp, Homo sapiens
ggagacatccattcggcggattgcc

SEQ ID NO: 13980 - DNA, 25 bp, Homo sapiens
gagacatccattcggcggattgccg

SEQ ID NO: 13981 - DNA, 25 bp, Homo sapiens
agacatccattcggcggattgccga

SEQ ID NO: 13982 - DNA, 25 bp, Homo sapiens
gacatccattcggcggattgccgac

SEQ ID NO: 13983 - DNA, 25 bp, Homo sapiens
acatccattcggcggattgccgacc

SEQ ID NO: 13984 - DNA, 25 bp, Homo sapiens
catccattcggcggattgccgacct

SEQ ID NO: 13985 - DNA, 25 bp, Homo sapiens
atccattcggcggattgccgacctg

SEQ ID NO: 13986 - DNA, 25 bp, Homo sapiens
tccattcggcggattgccgacctgc

SEQ ID NO: 13987 - DNA, 25 bp, Homo sapiens
ccattcggcggattgccgacctgca

SEQ ID NO: 13988 - DNA, 25 bp, Homo sapiens
cattcggcggattgccgacctgcag

SEQ ID NO: 13989 - DNA, 25 bp, Homo sapiens
attcggcggattgccgacctgcagg

SEQ ID NO: 13990 - DNA, 25 bp, Homo sapiens
ttcggcggattgccgacctgcaggc

SEQ ID NO: 13991 - DNA, 25 bp, Homo sapiens
tcggcggattgccgacctgcaggct

SEQ ID NO: 13992 - DNA, 25 bp, Homo sapiens
cggcggattgccgacctgcaggctg

SEQ ID NO: 13993 - DNA, 25 bp, Homo sapiens
ggcggattgccgacctgcaggctgc

SEQ ID NO: 13994 - DNA, 25 bp, Homo sapiens
gcggattgccgacctgcaggctgcc

SEQ ID NO: 13995 - DNA, 25 bp, Homo sapiens
cggattgccgacctgcaggctgcct

SEQ ID NO: 13996 - DNA, 25 bp, Homo sapiens
ggattgccgacctgcaggctgcctt

SEQ ID NO: 13997 - DNA, 25 bp, Homo sapiens
gattgccgacctgcaggctgccttg

SEQ ID NO: 13998 - DNA, 25 bp, Homo sapiens
attgccgacctgcaggctgccttgg

SEQ ID NO: 13999 - DNA, 25 bp, Homo sapiens
ttgccgacctgcaggctgccttgga

SEQ ID NO: 14000 - DNA, 25 bp, Homo sapiens
tgccgacctgcaggctgccttggaa

SEQ ID NO: 14001 - DNA, 25 bp, Homo sapiens
gccgacctgcaggctgccttggaag

SEQ ID NO: 14002 - DNA, 25 bp, Homo sapiens
ccgacctgcaggctgccttggaaga

SEQ ID NO: 14003 - DNA, 25 bp, Homo sapiens
cgacctgcaggctgccttggaagaa

SEQ ID NO: 14004 - DNA, 25 bp, Homo sapiens
gacctgcaggctgccttggaagaag

SEQ ID NO: 14005 - DNA, 25 bp, Homo sapiens
acctgcaggctgccttggaagaagt

SEQ ID NO: 14006 - DNA, 25 bp, Homo sapiens
cctgcaggctgccttggaagaagtg

SEQ ID NO: 14007 - DNA, 25 bp, Homo sapiens
ctgcaggctgccttggaagaagtgg

SEQ ID NO: 14008 - DNA, 25 bp, Homo sapiens
tgcaggctgccttggaagaagtggc

SEQ ID NO: 14009 - DNA, 25 bp, Homo sapiens
gcaggctgccttggaagaagtggca

SEQ ID NO: 14010 - DNA, 25 bp, Homo sapiens
caggctgccttggaagaagtggcat

SEQ ID NO: 14011 - DNA, 25 bp, Homo sapiens
aggctgccttggaagaagtggcatc

SEQ ID NO: 14012 - DNA, 25 bp, Homo sapiens
ggctgccttggaagaagtggcatcc

SEQ ID NO: 14013 - DNA, 25 bp, Homo sapiens
gctgccttggaagaagtggcatcca

SEQ ID NO: 14014 - DNA, 25 bp, Homo sapiens
ctgccttggaagaagtggcatccag

SEQ ID NO: 14015 - DNA, 25 bp, Homo sapiens
tgccttggaagaagtggcatccagt

SEQ ID NO: 14016 - DNA, 25 bp, Homo sapiens
gccttggaagaagtggcatccagtg

SEQ ID NO: 14017 - DNA, 25 bp, Homo sapiens
ccttggaagaagtggcatccagtga

SEQ ID NO: 14018 - DNA, 25 bp, Homo sapiens
cttggaagaagtggcatccagtgac

SEQ ID NO: 14019 - DNA, 25 bp, Homo sapiens
ttggaagaagtggcatccagtgaca

SEQ ID NO: 14020 - DNA, 25 bp, Homo sapiens
tggaagaagtggcatccagtgacag

SEQ ID NO: 14021 - DNA, 25 bp, Homo sapiens
ggaagaagtggcatccagtgacagt

SEQ ID NO: 14022 - DNA, 25 bp, Homo sapiens
gaagaagtggcatccagtgacagtg

SEQ ID NO: 14023 - DNA, 25 bp, Homo sapiens
aagaagtggcatccagtgacagtga

SEQ ID NO: 14024 - DNA, 25 bp, Homo sapiens
agaagtggcatccagtgacagtgat

SEQ ID NO: 14025 - DNA, 25 bp, Homo sapiens
gaagtggcatccagtgacagtgata

SEQ ID NO: 14026 - DNA, 25 bp, Homo sapiens
aagtggcatccagtgacagtgatac

SEQ ID NO: 14027 - DNA, 25 bp, Homo sapiens
agtggcatccagtgacagtgatact

SEQ ID NO: 14028 - DNA, 25 bp, Homo sapiens
gtggcatccagtgacagtgatactg

SEQ ID NO: 14029 - DNA, 25 bp, Homo sapiens
tggcatccagtgacagtgatactga

SEQ ID NO: 14030 - DNA, 25 bp, Homo sapiens
ggcatccagtgacagtgatactgag

SEQ ID NO: 14031 - DNA, 25 bp, Homo sapiens
gcatccagtgacagtgatactgaga

SEQ ID NO: 14032 - DNA, 25 bp, Homo sapiens
catccagtgacagtgatactgagag

SEQ ID NO: 14033 - DNA, 25 bp, Homo sapiens
atccagtgacagtgatactgagagt

SEQ ID NO: 14034 - DNA, 25 bp, Homo sapiens
tccagtgacagtgatactgagagtg

SEQ ID NO: 14035 - DNA, 25 bp, Homo sapiens
ccagtgacagtgatactgagagtgt

SEQ ID NO: 14036 - DNA, 25 bp, Homo sapiens
cagtgacagtgatactgagagtgtc

SEQ ID NO: 14037 - DNA, 25 bp, Homo sapiens
agtgacagtgatactgagagtgtcc

SEQ ID NO: 14038 - DNA, 25 bp, Homo sapiens
gtgacagtgatactgagagtgtcca

SEQ ID NO: 14039 - DNA, 25 bp, Homo sapiens
tgacagtgatactgagagtgtccag

SEQ ID NO: 14040 - DNA, 25 bp, Homo sapiens
gacagtgatactgagagtgtccaga

SEQ ID NO: 14041 - DNA, 25 bp, Homo sapiens
acagtgatactgagagtgtccagac

SEQ ID NO: 14042 - DNA, 25 bp, Homo sapiens
cagtgatactgagagtgtccagacg

SEQ ID NO: 14043 - DNA, 25 bp, Homo sapiens
agtgatactgagagtgtccagacgg

SEQ ID NO: 14044 - DNA, 25 bp, Homo sapiens
gtgatactgagagtgtccagacggc

SEQ ID NO: 14045 - DNA, 25 bp, Homo sapiens
tgatactgagagtgtccagacggca

SEQ ID NO: 14046 - DNA, 25 bp, Homo sapiens
gatactgagagtgtccagacggcag

SEQ ID NO: 14047 - DNA, 25 bp, Homo sapiens
atactgagagtgtccagacggcagt

SEQ ID NO: 14048 - DNA, 25 bp, Homo sapiens
tactgagagtgtccagacggcagtg

SEQ ID NO: 14049 - DNA, 25 bp, Homo sapiens
actgagagtgtccagacggcagtgg

SEQ ID NO: 14050 - DNA, 25 bp, Homo sapiens
ctgagagtgtccagacggcagtgga

SEQ ID NO: 14051 - DNA, 25 bp, Homo sapiens
tgagagtgtccagacggcagtggat

SEQ ID NO: 14052 - DNA, 25 bp, Homo sapiens
gagagtgtccagacggcagtggatt

SEQ ID NO: 14053 - DNA, 25 bp, Homo sapiens
agagtgtccagacggcagtggattg

SEQ ID NO: 14054 - DNA, 25 bp, Homo sapiens
gagtgtccagacggcagtggattgt

SEQ ID NO: 14055 - DNA, 25 bp, Homo sapiens
agtgtccagacggcagtggattgtg

SEQ ID NO: 14056 - DNA, 25 bp, Homo sapiens
gtgtccagacggcagtggattgtgg

SEQ ID NO: 14057 - DNA, 25 bp, Homo sapiens
tgtccagacggcagtggattgtggc

SEQ ID NO: 14058 - DNA, 25 bp, Homo sapiens
gtccagacggcagtggattgtggca

SEQ ID NO: 14059 - DNA, 25 bp, Homo sapiens
tccagacggcagtggattgtggcag

SEQ ID NO: 14060 - DNA, 25 bp, Homo sapiens
ccagacggcagtggattgtggcagc

SEQ ID NO: 14061 - DNA, 25 bp, Homo sapiens
cagacggcagtggattgtggcagca

SEQ ID NO: 14062 - DNA, 25 bp, Homo sapiens
agacggcagtggattgtggcagcag

SEQ ID NO: 14063 - DNA, 25 bp, Homo sapiens
gacggcagtggattgtggcagcagc

SEQ ID NO: 14064 - DNA, 25 bp, Homo sapiens
acggcagtggattgtggcagcagcg

SEQ ID NO: 14065 - DNA, 25 bp, Homo sapiens
cggcagtggattgtggcagcagcgg

SEQ ID NO: 14066 - DNA, 25 bp, Homo sapiens
ggcagtggattgtggcagcagcggc

SEQ ID NO: 14067 - DNA, 25 bp, Homo sapiens
gcagtggattgtggcagcagcggcc

SEQ ID NO: 14068 - DNA, 25 bp, Homo sapiens
cagtggattgtggcagcagcggccg

SEQ ID NO: 14069 - DNA, 25 bp, Homo sapiens
agtggattgtggcagcagcggccga

SEQ ID NO: 14070 - DNA, 25 bp, Homo sapiens
gtggattgtggcagcagcggccgaa

SEQ ID NO: 14071 - DNA, 25 bp, Homo sapiens
tggattgtggcagcagcggccgaaa

SEQ ID NO: 14072 - DNA, 25 bp, Homo sapiens
ggattgtggcagcagcggccgaaaa

SEQ ID NO: 14073 - DNA, 25 bp, Homo sapiens
gattgtggcagcagcggccgaaaag

SEQ ID NO: 14074 - DNA, 25 bp, Homo sapiens
attgtggcagcagcggccgaaaaga

SEQ ID NO: 14075 - DNA, 25 bp, Homo sapiens
ttgtggcagcagcggccgaaaagag

SEQ ID NO: 14076 - DNA, 25 bp, Homo sapiens
tgtggcagcagcggccgaaaagaga

SEQ ID NO: 14077 - DNA, 25 bp, Homo sapiens
gtggcagcagcggccgaaaagagat

SEQ ID NO: 14078 - DNA, 25 bp, Homo sapiens
tggcagcagcggccgaaaagagatg

SEQ ID NO: 14079 - DNA, 25 bp, Homo sapiens
ggcagcagcggccgaaaagagatgg

SEQ ID NO: 14080 - DNA, 25 bp, Homo sapiens
gcagcagcggccgaaaagagatgga

SEQ ID NO: 14081 - DNA, 25 bp, Homo sapiens
cagcagcggccgaaaagagatggat

SEQ ID NO: 14082 - DNA, 25 bp, Homo sapiens
agcagcggccgaaaagagatggata

SEQ ID NO: 14083 - DNA, 25 bp, Homo sapiens
gcagcggccgaaaagagatggataa

SEQ ID NO: 14084 - DNA, 25 bp, Homo sapiens
cagcggccgaaaagagatggataac

SEQ ID NO: 14085 - DNA, 25 bp, Homo sapiens
agcggccgaaaagagatggataacg

SEQ ID NO: 14086 - DNA, 25 bp, Homo sapiens
gcggccgaaaagagatggataacgt

SEQ ID NO: 14087 - DNA, 25 bp, Homo sapiens
cggccgaaaagagatggataacgtc

SEQ ID NO: 14088 - DNA, 25 bp, Homo sapiens
ggccgaaaagagatggataacgtct

SEQ ID NO: 14089 - DNA, 25 bp, Homo sapiens
gccgaaaagagatggataacgtctc

SEQ ID NO: 14090 - DNA, 25 bp, Homo sapiens
ccgaaaagagatggataacgtctcc

SEQ ID NO: 14091 - DNA, 25 bp, Homo sapiens
cgaaaagagatggataacgtctcca

SEQ ID NO: 14092 - DNA, 25 bp, Homo sapiens
gaaaagagatggataacgtctccat

SEQ ID NO: 14093 - DNA, 25 bp, Homo sapiens
aaaagagatggataacgtctccatc

SEQ ID NO: 14094 - DNA, 25 bp, Homo sapiens
aaagagatggataacgtctccatcc

SEQ ID NO: 14095 - DNA, 25 bp, Homo sapiens
aagagatggataacgtctccatcct

SEQ ID NO: 14096 - DNA, 25 bp, Homo sapiens
agagatggataacgtctccatcctc

SEQ ID NO: 14097 - DNA, 25 bp, Homo sapiens
gagatggataacgtctccatcctca

SEQ ID NO: 14098 - DNA, 25 bp, Homo sapiens
agatggataacgtctccatcctcag

SEQ ID NO: 14099 - DNA, 25 bp, Homo sapiens
gatggataacgtctccatcctcagc

SEQ ID NO: 14100 - DNA, 25 bp, Homo sapiens
atggataacgtctccatcctcagct

SEQ ID NO: 14101 - DNA, 25 bp, Homo sapiens
tggataacgtctccatcctcagctc

SEQ ID NO: 14102 - DNA, 25 bp, Homo sapiens
ggataacgtctccatcctcagctcc

SEQ ID NO: 14103 - DNA, 25 bp, Homo sapiens
gataacgtctccatcctcagctccc

SEQ ID NO: 14104 - DNA, 25 bp, Homo sapiens
ataacgtctccatcctcagctccca

SEQ ID NO: 14105 - DNA, 25 bp, Homo sapiens
taacgtctccatcctcagctcccag

SEQ ID NO: 14106 - DNA, 25 bp, Homo sapiens
aacgtctccatcctcagctcccagc

SEQ ID NO: 14107 - DNA, 25 bp, Homo sapiens
acgtctccatcctcagctcccagcc

SEQ ID NO: 14108 - DNA, 25 bp, Homo sapiens
cgtctccatcctcagctcccagcca

SEQ ID NO: 14109 - DNA, 25 bp, Homo sapiens
gtctccatcctcagctcccagccag

SEQ ID NO: 14110 - DNA, 25 bp, Homo sapiens
tctccatcctcagctcccagccaga

SEQ ID NO: 14111 - DNA, 25 bp, Homo sapiens
ctccatcctcagctcccagccagag

SEQ ID NO: 14112 - DNA, 25 bp, Homo sapiens
tccatcctcagctcccagccagagg

SEQ ID NO: 14113 - DNA, 25 bp, Homo sapiens
ccatcctcagctcccagccagaggg

SEQ ID NO: 14114 - DNA, 25 bp, Homo sapiens
catcctcagctcccagccagagggc

SEQ ID NO: 14115 - DNA, 25 bp, Homo sapiens
atcctcagctcccagccagagggca

SEQ ID NO: 14116 - DNA, 25 bp, Homo sapiens
tcctcagctcccagccagagggcag

SEQ ID NO: 14117 - DNA, 25 bp, Homo sapiens
cctcagctcccagccagagggcagc

SEQ ID NO: 14118 - DNA, 25 bp, Homo sapiens
ctcagctcccagccagagggcagcc

SEQ ID NO: 14119 - DNA, 25 bp, Homo sapiens
tcagctcccagccagagggcagcct

SEQ ID NO: 14120 - DNA, 25 bp, Homo sapiens
cagctcccagccagagggcagcctg

SEQ ID NO: 14121 - DNA, 25 bp, Homo sapiens
agctcccagccagagggcagcctgc

SEQ ID NO: 14122 - DNA, 25 bp, Homo sapiens
gctcccagccagagggcagcctgca

SEQ ID NO: 14123 - DNA, 25 bp, Homo sapiens
ctcccagccagagggcagcctgcag

SEQ ID NO: 14124 - DNA, 25 bp, Homo sapiens
tcccagccagagggcagcctgcagt

SEQ ID NO: 14125 - DNA, 25 bp, Homo sapiens
cccagccagagggcagcctgcagtc

SEQ ID NO: 14126 - DNA, 25 bp, Homo sapiens
ccagccagagggcagcctgcagtcc

SEQ ID NO: 14127 - DNA, 25 bp, Homo sapiens
cagccagagggcagcctgcagtcct

SEQ ID NO: 14128 - DNA, 25 bp, Homo sapiens
agccagagggcagcctgcagtcctg

SEQ ID NO: 14129 - DNA, 25 bp, Homo sapiens
gccagagggcagcctgcagtcctgg

SEQ ID NO: 14130 - DNA, 25 bp, Homo sapiens
ccagagggcagcctgcagtcctggt

SEQ ID NO: 14131 - DNA, 25 bp, Homo sapiens
cagagggcagcctgcagtcctggtt

SEQ ID NO: 14132 - DNA, 25 bp, Homo sapiens
agagggcagcctgcagtcctggttg

SEQ ID NO: 14133 - DNA, 25 bp, Homo sapiens
gagggcagcctgcagtcctggttga

SEQ ID NO: 14134 - DNA, 25 bp, Homo sapiens
agggcagcctgcagtcctggttgag

SEQ ID NO: 14135 - DNA, 25 bp, Homo sapiens
gggcagcctgcagtcctggttgagc

SEQ ID NO: 14136 - DNA, 25 bp, Homo sapiens
ggcagcctgcagtcctggttgagct

SEQ ID NO: 14137 - DNA, 25 bp, Homo sapiens
gcagcctgcagtcctggttgagctg

SEQ ID NO: 14138 - DNA, 25 bp, Homo sapiens
cagcctgcagtcctggttgagctgt

SEQ ID NO: 14139 - DNA, 25 bp, Homo sapiens
agcctgcagtcctggttgagctgta

SEQ ID NO: 14140 - DNA, 25 bp, Homo sapiens
gcctgcagtcctggttgagctgtac

SEQ ID NO: 14141 - DNA, 25 bp, Homo sapiens
cctgcagtcctggttgagctgtact

SEQ ID NO: 14142 - DNA, 25 bp, Homo sapiens
ctgcagtcctggttgagctgtactc

SEQ ID NO: 14143 - DNA, 25 bp, Homo sapiens
tgcagtcctggttgagctgtactct

SEQ ID NO: 14144 - DNA, 25 bp, Homo sapiens
gcagtcctggttgagctgtactctg

SEQ ID NO: 14145 - DNA, 25 bp, Homo sapiens
cagtcctggttgagctgtactctgt

SEQ ID NO: 14146 - DNA, 25 bp, Homo sapiens
agtcctggttgagctgtactctgtc

SEQ ID NO: 14147 - DNA, 25 bp, Homo sapiens
gtcctggttgagctgtactctgtcc

SEQ ID NO: 14148 - DNA, 25 bp, Homo sapiens
tcctggttgagctgtactctgtccc

SEQ ID NO: 14149 - DNA, 25 bp, Homo sapiens
cctggttgagctgtactctgtccct

SEQ ID NO: 14150 - DNA, 25 bp, Homo sapiens
ctggttgagctgtactctgtccctg

SEQ ID NO: 14151 - DNA, 25 bp, Homo sapiens
tggttgagctgtactctgtccctgg

SEQ ID NO: 14152 - DNA, 25 bp, Homo sapiens
ggttgagctgtactctgtccctggc

SEQ ID NO: 14153 - DNA, 25 bp, Homo sapiens
gttgagctgtactctgtccctggcc

SEQ ID NO: 14154 - DNA, 25 bp, Homo sapiens
ttgagctgtactctgtccctggcca

SEQ ID NO: 14155 - DNA, 25 bp, Homo sapiens
tgagctgtactctgtccctggccac

SEQ ID NO: 14156 - DNA, 25 bp, Homo sapiens
gagctgtactctgtccctggccaca

SEQ ID NO: 14157 - DNA, 25 bp, Homo sapiens
agctgtactctgtccctggccacag

SEQ ID NO: 14158 - DNA, 25 bp, Homo sapiens
gctgtactctgtccctggccacaga

SEQ ID NO: 14159 - DNA, 25 bp, Homo sapiens
ctgtactctgtccctggccacagat

SEQ ID NO: 14160 - DNA, 25 bp, Homo sapiens
tgtactctgtccctggccacagata

SEQ ID NO: 14161 - DNA, 25 bp, Homo sapiens
gtactctgtccctggccacagatac

SEQ ID NO: 14162 - DNA, 25 bp, Homo sapiens
tactctgtccctggccacagatact

SEQ ID NO: 14163 - DNA, 25 bp, Homo sapiens
actctgtccctggccacagatacta

SEQ ID NO: 14164 - DNA, 25 bp, Homo sapiens
ctctgtccctggccacagatactat

SEQ ID NO: 14165 - DNA, 25 bp, Homo sapiens
tctgtccctggccacagatactatg

SEQ ID NO: 14166 - DNA, 25 bp, Homo sapiens
ctgtccctggccacagatactatga

SEQ ID NO: 14167 - DNA, 25 bp, Homo sapiens
tgtccctggccacagatactatgag

SEQ ID NO: 14168 - DNA, 25 bp, Homo sapiens
gtccctggccacagatactatgagg

SEQ ID NO: 14169 - DNA, 25 bp, Homo sapiens
tccctggccacagatactatgagga

SEQ ID NO: 14170 - DNA, 25 bp, Homo sapiens
ccctggccacagatactatgaggac

SEQ ID NO: 14171 - DNA, 25 bp, Homo sapiens
cctggccacagatactatgaggact

SEQ ID NO: 14172 - DNA, 25 bp, Homo sapiens
ctggccacagatactatgaggactc

SEQ ID NO: 14173 - DNA, 25 bp, Homo sapiens
tggccacagatactatgaggactcc

SEQ ID NO: 14174 - DNA, 25 bp, Homo sapiens
ggccacagatactatgaggactcct

SEQ ID NO: 14175 - DNA, 25 bp, Homo sapiens
gccacagatactatgaggactcctt

SEQ ID NO: 14176 - DNA, 25 bp, Homo sapiens
ccacagatactatgaggactccttc

SEQ ID NO: 14177 - DNA, 25 bp, Homo sapiens
cacagatactatgaggactccttct

SEQ ID NO: 14178 - DNA, 25 bp, Homo sapiens
acagatactatgaggactccttctc

SEQ ID NO: 14179 - DNA, 25 bp, Homo sapiens
cagatactatgaggactccttctcg

SEQ ID NO: 14180 - DNA, 25 bp, Homo sapiens
agatactatgaggactccttctcga

SEQ ID NO: 14181 - DNA, 25 bp, Homo sapiens
gatactatgaggactccttctcgac

SEQ ID NO: 14182 - DNA, 25 bp, Homo sapiens
atactatgaggactccttctcgaca

SEQ ID NO: 14183 - DNA, 25 bp, Homo sapiens
tactatgaggactccttctcgacag

SEQ ID NO: 14184 - DNA, 25 bp, Homo sapiens
actatgaggactccttctcgacagt

SEQ ID NO: 14185 - DNA, 25 bp, Homo sapiens
ctatgaggactccttctcgacagtc

SEQ ID NO: 14186 - DNA, 25 bp, Homo sapiens
tatgaggactccttctcgacagtca

SEQ ID NO: 14187 - DNA, 25 bp, Homo sapiens
atgaggactccttctcgacagtcag

SEQ ID NO: 14188 - DNA, 25 bp, Homo sapiens
tgaggactccttctcgacagtcagc

SEQ ID NO: 14189 - DNA, 25 bp, Homo sapiens
gaggactccttctcgacagtcagcc

SEQ ID NO: 14190 - DNA, 25 bp, Homo sapiens
aggactccttctcgacagtcagcca

SEQ ID NO: 14191 - DNA, 25 bp, Homo sapiens
ggactccttctcgacagtcagccac

SEQ ID NO: 14192 - DNA, 25 bp, Homo sapiens
gactccttctcgacagtcagccacc

SEQ ID NO: 14193 - DNA, 25 bp, Homo sapiens
actccttctcgacagtcagccacca

SEQ ID NO: 14194 - DNA, 25 bp, Homo sapiens
ctccttctcgacagtcagccaccag

SEQ ID NO: 14195 - DNA, 25 bp, Homo sapiens
tccttctcgacagtcagccaccagc

SEQ ID NO: 14196 - DNA, 25 bp, Homo sapiens
ccttctcgacagtcagccaccagca

SEQ ID NO: 14197 - DNA, 25 bp, Homo sapiens
cttctcgacagtcagccaccagcag

SEQ ID NO: 14198 - DNA, 25 bp, Homo sapiens
ttctcgacagtcagccaccagcagc

SEQ ID NO: 14199 - DNA, 25 bp, Homo sapiens
tctcgacagtcagccaccagcagcc

SEQ ID NO: 14200 - DNA, 25 bp, Homo sapiens
ctcgacagtcagccaccagcagccg

SEQ ID NO: 14201 - DNA, 25 bp, Homo sapiens
tcgacagtcagccaccagcagccgc

SEQ ID NO: 14202 - DNA, 25 bp, Homo sapiens
cgacagtcagccaccagcagccgca

SEQ ID NO: 14203 - DNA, 25 bp, Homo sapiens
gacagtcagccaccagcagccgcat

SEQ ID NO: 14204 - DNA, 25 bp, Homo sapiens
acagtcagccaccagcagccgcatc

SEQ ID NO: 14205 - DNA, 25 bp, Homo sapiens
cagtcagccaccagcagccgcatcc

SEQ ID NO: 14206 - DNA, 25 bp, Homo sapiens
agtcagccaccagcagccgcatcct

SEQ ID NO: 14207 - DNA, 25 bp, Homo sapiens
gtcagccaccagcagccgcatcctc

SEQ ID NO: 14208 - DNA, 25 bp, Homo sapiens
tcagccaccagcagccgcatcctca

SEQ ID NO: 14209 - DNA, 25 bp, Homo sapiens
cagccaccagcagccgcatcctcag

SEQ ID NO: 14210 - DNA, 25 bp, Homo sapiens
agccaccagcagccgcatcctcagc

SEQ ID NO: 14211 - DNA, 25 bp, Homo sapiens
gccaccagcagccgcatcctcagcc

SEQ ID NO: 14212 - DNA, 25 bp, Homo sapiens
ccaccagcagccgcatcctcagccc

SEQ ID NO: 14213 - DNA, 25 bp, Homo sapiens
caccagcagccgcatcctcagcccc

SEQ ID NO: 14214 - DNA, 25 bp, Homo sapiens
accagcagccgcatcctcagcccca

SEQ ID NO: 14215 - DNA, 25 bp, Homo sapiens
ccagcagccgcatcctcagccccag

SEQ ID NO: 14216 - DNA, 25 bp, Homo sapiens
cagcagccgcatcctcagccccagg

SEQ ID NO: 14217 - DNA, 25 bp, Homo sapiens
agcagccgcatcctcagccccagga

SEQ ID NO: 14218 - DNA, 25 bp, Homo sapiens
gcagccgcatcctcagccccaggat

SEQ ID NO: 14219 - DNA, 25 bp, Homo sapiens
cagccgcatcctcagccccaggata

SEQ ID NO: 14220 - DNA, 25 bp, Homo sapiens
agccgcatcctcagccccaggataa

SEQ ID NO: 14221 - DNA, 25 bp, Homo sapiens
gccgcatcctcagccccaggataaa

SEQ ID NO: 14222 - DNA, 25 bp, Homo sapiens
ccgcatcctcagccccaggataaac

SEQ ID NO: 14223 - DNA, 25 bp, Homo sapiens
cgcatcctcagccccaggataaacg

SEQ ID NO: 14224 - DNA, 25 bp, Homo sapiens
gcatcctcagccccaggataaacga

SEQ ID NO: 14225 - DNA, 25 bp, Homo sapiens
catcctcagccccaggataaacgaa

SEQ ID NO: 14226 - DNA, 25 bp, Homo sapiens
atcctcagccccaggataaacgaag

SEQ ID NO: 14227 - DNA, 25 bp, Homo sapiens
tcctcagccccaggataaacgaaga

SEQ ID NO: 14228 - DNA, 25 bp, Homo sapiens
cctcagccccaggataaacgaagag

SEQ ID NO: 14229 - DNA, 25 bp, Homo sapiens
ctcagccccaggataaacgaagagg

SEQ ID NO: 14230 - DNA, 25 bp, Homo sapiens
tcagccccaggataaacgaagaggc

SEQ ID NO: 14231 - DNA, 25 bp, Homo sapiens
cagccccaggataaacgaagaggct

SEQ ID NO: 14232 - DNA, 25 bp, Homo sapiens
agccccaggataaacgaagaggctg

SEQ ID NO: 14233 - DNA, 25 bp, Homo sapiens
gccccaggataaacgaagaggctgg

SEQ ID NO: 14234 - DNA, 25 bp, Homo sapiens
ccccaggataaacgaagaggctggg

SEQ ID NO: 14235 - DNA, 25 bp, Homo sapiens
cccaggataaacgaagaggctgggg

SEQ ID NO: 14236 - DNA, 25 bp, Homo sapiens
ccaggataaacgaagaggctgggga

SEQ ID NO: 14237 - DNA, 25 bp, Homo sapiens
caggataaacgaagaggctggggac

SEQ ID NO: 14238 - DNA, 25 bp, Homo sapiens
aggataaacgaagaggctggggaca

SEQ ID NO: 14239 - DNA, 25 bp, Homo sapiens
ggataaacgaagaggctggggacac

SEQ ID NO: 14240 - DNA, 25 bp, Homo sapiens
gataaacgaagaggctggggacact

SEQ ID NO: 14241 - DNA, 25 bp, Homo sapiens
ataaacgaagaggctggggacactg

SEQ ID NO: 14242 - DNA, 25 bp, Homo sapiens
taaacgaagaggctggggacactga

SEQ ID NO: 14243 - DNA, 25 bp, Homo sapiens
aaacgaagaggctggggacactgag

SEQ ID NO: 14244 - DNA, 25 bp, Homo sapiens
aacgaagaggctggggacactgaga

SEQ ID NO: 14245 - DNA, 25 bp, Homo sapiens
acgaagaggctggggacactgagag

SEQ ID NO: 14246 - DNA, 25 bp, Homo sapiens
cgaagaggctggggacactgagagg

SEQ ID NO: 14247 - DNA, 25 bp, Homo sapiens
gaagaggctggggacactgagagga

SEQ ID NO: 14248 - DNA, 25 bp, Homo sapiens
aagaggctggggacactgagaggac

SEQ ID NO: 14249 - DNA, 25 bp, Homo sapiens
agaggctggggacactgagaggacc

SEQ ID NO: 14250 - DNA, 25 bp, Homo sapiens
gaggctggggacactgagaggaccc

SEQ ID NO: 14251 - DNA, 25 bp, Homo sapiens
aggctggggacactgagaggaccca

SEQ ID NO: 14252 - DNA, 25 bp, Homo sapiens
ggctggggacactgagaggacccag

SEQ ID NO: 14253 - DNA, 25 bp, Homo sapiens
gctggggacactgagaggacccagt

SEQ ID NO: 14254 - DNA, 25 bp, Homo sapiens
ctggggacactgagaggacccagtc

SEQ ID NO: 14255 - DNA, 25 bp, Homo sapiens
tggggacactgagaggacccagtcg

SEQ ID NO: 14256 - DNA, 25 bp, Homo sapiens
ggggacactgagaggacccagtcgg

SEQ ID NO: 14257 - DNA, 25 bp, Homo sapiens
gggacactgagaggacccagtcggc

SEQ ID NO: 14258 - DNA, 25 bp, Homo sapiens
ggacactgagaggacccagtcggca

SEQ ID NO: 14259 - DNA, 25 bp, Homo sapiens
gacactgagaggacccagtcggcat

SEQ ID NO: 14260 - DNA, 25 bp, Homo sapiens
acactgagaggacccagtcggcatt

SEQ ID NO: 14261 - DNA, 25 bp, Homo sapiens
cactgagaggacccagtcggcattg

SEQ ID NO: 14262 - DNA, 25 bp, Homo sapiens
actgagaggacccagtcggcattgg

SEQ ID NO: 14263 - DNA, 25 bp, Homo sapiens
ctgagaggacccagtcggcattggc

SEQ ID NO: 14264 - DNA, 25 bp, Homo sapiens
tgagaggacccagtcggcattggca

SEQ ID NO: 14265 - DNA, 25 bp, Homo sapiens
gagaggacccagtcggcattggcac

SEQ ID NO: 14266 - DNA, 25 bp, Homo sapiens
agaggacccagtcggcattggcact

SEQ ID NO: 14267 - DNA, 25 bp, Homo sapiens
gaggacccagtcggcattggcactg

SEQ ID NO: 14268 - DNA, 25 bp, Homo sapiens
aggacccagtcggcattggcactga

SEQ ID NO: 14269 - DNA, 25 bp, Homo sapiens
ggacccagtcggcattggcactgag

SEQ ID NO: 14270 - DNA, 25 bp, Homo sapiens
gacccagtcggcattggcactgagc

SEQ ID NO: 14271 - DNA, 25 bp, Homo sapiens
acccagtcggcattggcactgagca

SEQ ID NO: 14272 - DNA, 25 bp, Homo sapiens
cccagtcggcattggcactgagcag

SEQ ID NO: 14273 - DNA, 25 bp, Homo sapiens
ccagtcggcattggcactgagcaga

SEQ ID NO: 14274 - DNA, 25 bp, Homo sapiens
cagtcggcattggcactgagcagag

SEQ ID NO: 14275 - DNA, 25 bp, Homo sapiens
agtcggcattggcactgagcagagc

SEQ ID NO: 14276 - DNA, 25 bp, Homo sapiens
gtcggcattggcactgagcagagcc

SEQ ID NO: 14277 - DNA, 25 bp, Homo sapiens
tcggcattggcactgagcagagccc

SEQ ID NO: 14278 - DNA, 25 bp, Homo sapiens
cggcattggcactgagcagagcccg

SEQ ID NO: 14279 - DNA, 25 bp, Homo sapiens
ggcattggcactgagcagagcccgg

SEQ ID NO: 14280 - DNA, 25 bp, Homo sapiens
gcattggcactgagcagagcccggt

SEQ ID NO: 14281 - DNA, 25 bp, Homo sapiens
cattggcactgagcagagcccggtc

SEQ ID NO: 14282 - DNA, 25 bp, Homo sapiens
attggcactgagcagagcccggtcc

SEQ ID NO: 14283 - DNA, 25 bp, Homo sapiens
ttggcactgagcagagcccggtcca

SEQ ID NO: 14284 - DNA, 25 bp, Homo sapiens
tggcactgagcagagcccggtccac

SEQ ID NO: 14285 - DNA, 25 bp, Homo sapiens
ggcactgagcagagcccggtccacc

SEQ ID NO: 14286 - DNA, 25 bp, Homo sapiens
gcactgagcagagcccggtccacca

SEQ ID NO: 14287 - DNA, 25 bp, Homo sapiens
cactgagcagagcccggtccaccaa

SEQ ID NO: 14288 - DNA, 25 bp, Homo sapiens
actgagcagagcccggtccaccaat

SEQ ID NO: 14289 - DNA, 25 bp, Homo sapiens
ctgagcagagcccggtccaccaatg

SEQ ID NO: 14290 - DNA, 25 bp, Homo sapiens
tgagcagagcccggtccaccaatgt

SEQ ID NO: 14291 - DNA, 25 bp, Homo sapiens
gagcagagcccggtccaccaatgtc

SEQ ID NO: 14292 - DNA, 25 bp, Homo sapiens
agcagagcccggtccaccaatgtcc

SEQ ID NO: 14293 - DNA, 25 bp, Homo sapiens
gcagagcccggtccaccaatgtcca

SEQ ID NO: 14294 - DNA, 25 bp, Homo sapiens
cagagcccggtccaccaatgtccac

SEQ ID NO: 14295 - DNA, 25 bp, Homo sapiens
agagcccggtccaccaatgtccaca

SEQ ID NO: 14296 - DNA, 25 bp, Homo sapiens
gagcccggtccaccaatgtccacag

SEQ ID NO: 14297 - DNA, 25 bp, Homo sapiens
agcccggtccaccaatgtccacagc

SEQ ID NO: 14298 - DNA, 25 bp, Homo sapiens
gcccggtccaccaatgtccacagca

SEQ ID NO: 14299 - DNA, 25 bp, Homo sapiens
cccggtccaccaatgtccacagcaa

SEQ ID NO: 14300 - DNA, 25 bp, Homo sapiens
ccggtccaccaatgtccacagcaag

SEQ ID NO: 14301 - DNA, 25 bp, Homo sapiens
cggtccaccaatgtccacagcaaga

SEQ ID NO: 14302 - DNA, 25 bp, Homo sapiens
ggtccaccaatgtccacagcaagac

SEQ ID NO: 14303 - DNA, 25 bp, Homo sapiens
gtccaccaatgtccacagcaagacc

SEQ ID NO: 14304 - DNA, 25 bp, Homo sapiens
tccaccaatgtccacagcaagacct

SEQ ID NO: 14305 - DNA, 25 bp, Homo sapiens
ccaccaatgtccacagcaagacctc

SEQ ID NO: 14306 - DNA, 25 bp, Homo sapiens
caccaatgtccacagcaagacctca

SEQ ID NO: 14307 - DNA, 25 bp, Homo sapiens
accaatgtccacagcaagacctcag

SEQ ID NO: 14308 - DNA, 25 bp, Homo sapiens
ccaatgtccacagcaagacctcagg

SEQ ID NO: 14309 - DNA, 25 bp, Homo sapiens
caatgtccacagcaagacctcagga

SEQ ID NO: 14310 - DNA, 25 bp, Homo sapiens
aatgtccacagcaagacctcaggag

SEQ ID NO: 14311 - DNA, 25 bp, Homo sapiens
atgtccacagcaagacctcaggaga

SEQ ID NO: 14312 - DNA, 25 bp, Homo sapiens
tgtccacagcaagacctcaggagac

SEQ ID NO: 14313 - DNA, 25 bp, Homo sapiens
gtccacagcaagacctcaggagaca

SEQ ID NO: 14314 - DNA, 25 bp, Homo sapiens
tccacagcaagacctcaggagacaa

SEQ ID NO: 14315 - DNA, 25 bp, Homo sapiens
ccacagcaagacctcaggagacaag

SEQ ID NO: 14316 - DNA, 25 bp, Homo sapiens
cacagcaagacctcaggagacaagc

SEQ ID NO: 14317 - DNA, 25 bp, Homo sapiens
acagcaagacctcaggagacaagcc

SEQ ID NO: 14318 - DNA, 25 bp, Homo sapiens
cagcaagacctcaggagacaagcct

SEQ ID NO: 14319 - DNA, 25 bp, Homo sapiens
agcaagacctcaggagacaagcctg

SEQ ID NO: 14320 - DNA, 25 bp, Homo sapiens
gcaagacctcaggagacaagcctgt

SEQ ID NO: 14321 - DNA, 25 bp, Homo sapiens
caagacctcaggagacaagcctgtt

SEQ ID NO: 14322 - DNA, 25 bp, Homo sapiens
aagacctcaggagacaagcctgttt

SEQ ID NO: 14323 - DNA, 25 bp, Homo sapiens
agacctcaggagacaagcctgtttc

SEQ ID NO: 14324 - DNA, 25 bp, Homo sapiens
gacctcaggagacaagcctgtttct

SEQ ID NO: 14325 - DNA, 25 bp, Homo sapiens
acctcaggagacaagcctgtttctc

SEQ ID NO: 14326 - DNA, 25 bp, Homo sapiens
cctcaggagacaagcctgtttctcc

SEQ ID NO: 14327 - DNA, 25 bp, Homo sapiens
ctcaggagacaagcctgtttctccc

SEQ ID NO: 14328 - DNA, 25 bp, Homo sapiens
tcaggagacaagcctgtttctcccc

SEQ ID NO: 14329 - DNA, 25 bp, Homo sapiens
caggagacaagcctgtttctcccca

SEQ ID NO: 14330 - DNA, 25 bp, Homo sapiens
aggagacaagcctgtttctccccac

SEQ ID NO: 14331 - DNA, 25 bp, Homo sapiens
ggagacaagcctgtttctccccact

SEQ ID NO: 14332 - DNA, 25 bp, Homo sapiens
gagacaagcctgtttctccccactt

SEQ ID NO: 14333 - DNA, 25 bp, Homo sapiens
agacaagcctgtttctccccacttt

SEQ ID NO: 14334 - DNA, 25 bp, Homo sapiens
gacaagcctgtttctccccactttg

SEQ ID NO: 14335 - DNA, 25 bp, Homo sapiens
acaagcctgtttctccccactttgt

SEQ ID NO: 14336 - DNA, 25 bp, Homo sapiens
caagcctgtttctccccactttgtc

SEQ ID NO: 14337 - DNA, 25 bp, Homo sapiens
aagcctgtttctccccactttgtcc

SEQ ID NO: 14338 - DNA, 25 bp, Homo sapiens
agcctgtttctccccactttgtccg

SEQ ID NO: 14339 - DNA, 25 bp, Homo sapiens
gcctgtttctccccactttgtccgc

SEQ ID NO: 14340 - DNA, 25 bp, Homo sapiens
cctgtttctccccactttgtccgcc

SEQ ID NO: 14341 - DNA, 25 bp, Homo sapiens
ctgtttctccccactttgtccgccg

SEQ ID NO: 14342 - DNA, 25 bp, Homo sapiens
tgtttctccccactttgtccgccgg

SEQ ID NO: 14343 - DNA, 25 bp, Homo sapiens
gtttctccccactttgtccgccggc

SEQ ID NO: 14344 - DNA, 25 bp, Homo sapiens
tttctccccactttgtccgccggca

SEQ ID NO: 14345 - DNA, 25 bp, Homo sapiens
ttctccccactttgtccgccggcaa

SEQ ID NO: 14346 - DNA, 25 bp, Homo sapiens
tctccccactttgtccgccggcaaa

SEQ ID NO: 14347 - DNA, 25 bp, Homo sapiens
ctccccactttgtccgccggcaaaa

SEQ ID NO: 14348 - DNA, 25 bp, Homo sapiens
tccccactttgtccgccggcaaaag

SEQ ID NO: 14349 - DNA, 25 bp, Homo sapiens
ccccactttgtccgccggcaaaagt

SEQ ID NO: 14350 - DNA, 25 bp, Homo sapiens
cccactttgtccgccggcaaaagta

SEQ ID NO: 14351 - DNA, 25 bp, Homo sapiens
ccactttgtccgccggcaaaagtac

SEQ ID NO: 14352 - DNA, 25 bp, Homo sapiens
cactttgtccgccggcaaaagtact

SEQ ID NO: 14353 - DNA, 25 bp, Homo sapiens
actttgtccgccggcaaaagtactg

SEQ ID NO: 14354 - DNA, 25 bp, Homo sapiens
ctttgtccgccggcaaaagtactgt

SEQ ID NO: 14355 - DNA, 25 bp, Homo sapiens
tttgtccgccggcaaaagtactgtc

SEQ ID NO: 14356 - DNA, 25 bp, Homo sapiens
ttgtccgccggcaaaagtactgtca

SEQ ID NO: 14357 - DNA, 25 bp, Homo sapiens
tgtccgccggcaaaagtactgtcat

SEQ ID NO: 14358 - DNA, 25 bp, Homo sapiens
gtccgccggcaaaagtactgtcatt

SEQ ID NO: 14359 - DNA, 25 bp, Homo sapiens
tccgccggcaaaagtactgtcattt

SEQ ID NO: 14360 - DNA, 25 bp, Homo sapiens
ccgccggcaaaagtactgtcatttt

SEQ ID NO: 14361 - DNA, 25 bp, Homo sapiens
cgccggcaaaagtactgtcattttg

SEQ ID NO: 14362 - DNA, 25 bp, Homo sapiens
gccggcaaaagtactgtcattttgg

SEQ ID NO: 14363 - DNA, 25 bp, Homo sapiens
ccggcaaaagtactgtcattttggg

SEQ ID NO: 14364 - DNA, 25 bp, Homo sapiens
cggcaaaagtactgtcattttgggg

SEQ ID NO: 14365 - DNA, 25 bp, Homo sapiens
ggcaaaagtactgtcattttgggga

SEQ ID NO: 14366 - DNA, 25 bp, Homo sapiens
gcaaaagtactgtcattttggggac

SEQ ID NO: 14367 - DNA, 25 bp, Homo sapiens
caaaagtactgtcattttggggacg

SEQ ID NO: 14368 - DNA, 25 bp, Homo sapiens
aaaagtactgtcattttggggacgg

SEQ ID NO: 14369 - DNA, 25 bp, Homo sapiens
aaagtactgtcattttggggacggc

SEQ ID NO: 14370 - DNA, 25 bp, Homo sapiens
aagtactgtcattttggggacggcg

SEQ ID NO: 14371 - DNA, 25 bp, Homo sapiens
agtactgtcattttggggacggcga

SEQ ID NO: 14372 - DNA, 25 bp, Homo sapiens
gtactgtcattttggggacggcgaa

SEQ ID NO: 14373 - DNA, 25 bp, Homo sapiens
tactgtcattttggggacggcgaag

SEQ ID NO: 14374 - DNA, 25 bp, Homo sapiens
actgtcattttggggacggcgaagt

SEQ ID NO: 14375 - DNA, 25 bp, Homo sapiens
ctgtcattttggggacggcgaagtg

SEQ ID NO: 14376 - DNA, 25 bp, Homo sapiens
tgtcattttggggacggcgaagtgc

SEQ ID NO: 14377 - DNA, 25 bp, Homo sapiens
gtcattttggggacggcgaagtgct

SEQ ID NO: 14378 - DNA, 25 bp, Homo sapiens
tcattttggggacggcgaagtgctt

SEQ ID NO: 14379 - DNA, 25 bp, Homo sapiens
cattttggggacggcgaagtgcttg

SEQ ID NO: 14380 - DNA, 25 bp, Homo sapiens
attttggggacggcgaagtgcttgc

SEQ ID NO: 14381 - DNA, 25 bp, Homo sapiens
ttttggggacggcgaagtgcttgcc

SEQ ID NO: 14382 - DNA, 25 bp, Homo sapiens
tttggggacggcgaagtgcttgccg

SEQ ID NO: 14383 - DNA, 25 bp, Homo sapiens
ttggggacggcgaagtgcttgccgt

SEQ ID NO: 14384 - DNA, 25 bp, Homo sapiens
tggggacggcgaagtgcttgccgtc

SEQ ID NO: 14385 - DNA, 25 bp, Homo sapiens
ggggacggcgaagtgcttgccgtcc

SEQ ID NO: 14386 - DNA, 25 bp, Homo sapiens
gggacggcgaagtgcttgccgtcca

SEQ ID NO: 14387 - DNA, 25 bp, Homo sapiens
ggacggcgaagtgcttgccgtccag

SEQ ID NO: 14388 - DNA, 25 bp, Homo sapiens
gacggcgaagtgcttgccgtccaga

SEQ ID NO: 14389 - DNA, 25 bp, Homo sapiens
acggcgaagtgcttgccgtccagag

SEQ ID NO: 14390 - DNA, 25 bp, Homo sapiens
cggcgaagtgcttgccgtccagaga

SEQ ID NO: 14391 - DNA, 25 bp, Homo sapiens
ggcgaagtgcttgccgtccagagaa

SEQ ID NO: 14392 - DNA, 25 bp, Homo sapiens
gcgaagtgcttgccgtccagagaaa

SEQ ID NO: 14393 - DNA, 25 bp, Homo sapiens
cgaagtgcttgccgtccagagaaag

SEQ ID NO: 14394 - DNA, 25 bp, Homo sapiens
gaagtgcttgccgtccagagaaagt

SEQ ID NO: 14395 - DNA, 25 bp, Homo sapiens
aagtgcttgccgtccagagaaagtc

SEQ ID NO: 14396 - DNA, 25 bp, Homo sapiens
agtgcttgccgtccagagaaagtcc

SEQ ID NO: 14397 - DNA, 25 bp, Homo sapiens
gtgcttgccgtccagagaaagtcca

SEQ ID NO: 14398 - DNA, 25 bp, Homo sapiens
tgcttgccgtccagagaaagtccac

SEQ ID NO: 14399 - DNA, 25 bp, Homo sapiens
gcttgccgtccagagaaagtccaca

SEQ ID NO: 14400 - DNA, 25 bp, Homo sapiens
cttgccgtccagagaaagtccacag

SEQ ID NO: 14401 - DNA, 25 bp, Homo sapiens
ttgccgtccagagaaagtccacaga

SEQ ID NO: 14402 - DNA, 25 bp, Homo sapiens
tgccgtccagagaaagtccacagag

SEQ ID NO: 14403 - DNA, 25 bp, Homo sapiens
gccgtccagagaaagtccacagaga

SEQ ID NO: 14404 - DNA, 25 bp, Homo sapiens
ccgtccagagaaagtccacagagag

SEQ ID NO: 14405 - DNA, 25 bp, Homo sapiens
cgtccagagaaagtccacagagaga

SEQ ID NO: 14406 - DNA, 25 bp, Homo sapiens
gtccagagaaagtccacagagagat

SEQ ID NO: 14407 - DNA, 25 bp, Homo sapiens
tccagagaaagtccacagagagatt

SEQ ID NO: 14408 - DNA, 25 bp, Homo sapiens
ccagagaaagtccacagagagatta

SEQ ID NO: 14409 - DNA, 25 bp, Homo sapiens
cagagaaagtccacagagagattag

SEQ ID NO: 14410 - DNA, 25 bp, Homo sapiens
agagaaagtccacagagagattaga

SEQ ID NO: 14411 - DNA, 25 bp, Homo sapiens
gagaaagtccacagagagattagaa

SEQ ID NO: 14412 - DNA, 25 bp, Homo sapiens
agaaagtccacagagagattagaac

SEQ ID NO: 14413 - DNA, 25 bp, Homo sapiens
gaaagtccacagagagattagaacc

SEQ ID NO: 14414 - DNA, 25 bp, Homo sapiens
aaagtccacagagagattagaacct

SEQ ID NO: 14415 - DNA, 25 bp, Homo sapiens
aagtccacagagagattagaacctg

SEQ ID NO: 14416 - DNA, 25 bp, Homo sapiens
agtccacagagagattagaacctgc

SEQ ID NO: 14417 - DNA, 25 bp, Homo sapiens
gtccacagagagattagaacctgct

SEQ ID NO: 14418 - DNA, 25 bp, Homo sapiens
tccacagagagattagaacctgctt

SEQ ID NO: 14419 - DNA, 25 bp, Homo sapiens
ccacagagagattagaacctgcttc

SEQ ID NO: 14420 - DNA, 25 bp, Homo sapiens
cacagagagattagaacctgcttcc

SEQ ID NO: 14421 - DNA, 25 bp, Homo sapiens
acagagagattagaacctgcttcct

SEQ ID NO: 14422 - DNA, 25 bp, Homo sapiens
cagagagattagaacctgcttcctc

SEQ ID NO: 14423 - DNA, 25 bp, Homo sapiens
agagagattagaacctgcttcctct

SEQ ID NO: 14424 - DNA, 25 bp, Homo sapiens
gagagattagaacctgcttcctctc

SEQ ID NO: 14425 - DNA, 25 bp, Homo sapiens
agagattagaacctgcttcctctcc

SEQ ID NO: 14426 - DNA, 25 bp, Homo sapiens
gagattagaacctgcttcctctccc

SEQ ID NO: 14427 - DNA, 25 bp, Homo sapiens
agattagaacctgcttcctctcccc

SEQ ID NO: 14428 - DNA, 25 bp, Homo sapiens
gattagaacctgcttcctctcccct

SEQ ID NO: 14429 - DNA, 25 bp, Homo sapiens
attagaacctgcttcctctcccctg

SEQ ID NO: 14430 - DNA, 25 bp, Homo sapiens
ttagaacctgcttcctctcccctgg

SEQ ID NO: 14431 - DNA, 25 bp, Homo sapiens
tagaacctgcttcctctcccctggc

SEQ ID NO: 14432 - DNA, 25 bp, Homo sapiens
agaacctgcttcctctcccctggct

SEQ ID NO: 14433 - DNA, 25 bp, Homo sapiens
gaacctgcttcctctcccctggctt

SEQ ID NO: 14434 - DNA, 25 bp, Homo sapiens
aacctgcttcctctcccctggcttc

SEQ ID NO: 14435 - DNA, 25 bp, Homo sapiens
acctgcttcctctcccctggcttct

SEQ ID NO: 14436 - DNA, 25 bp, Homo sapiens
cctgcttcctctcccctggcttctc

SEQ ID NO: 14437 - DNA, 25 bp, Homo sapiens
ctgcttcctctcccctggcttctcg

SEQ ID NO: 14438 - DNA, 25 bp, Homo sapiens
tgcttcctctcccctggcttctcgg

SEQ ID NO: 14439 - DNA, 25 bp, Homo sapiens
gcttcctctcccctggcttctcgga

SEQ ID NO: 14440 - DNA, 25 bp, Homo sapiens
cttcctctcccctggcttctcggag

SEQ ID NO: 14441 - DNA, 25 bp, Homo sapiens
ttcctctcccctggcttctcggagt

SEQ ID NO: 14442 - DNA, 25 bp, Homo sapiens
tcctctcccctggcttctcggagta

SEQ ID NO: 14443 - DNA, 25 bp, Homo sapiens
cctctcccctggcttctcggagtac

SEQ ID NO: 14444 - DNA, 25 bp, Homo sapiens
ctctcccctggcttctcggagtaca

SEQ ID NO: 14445 - DNA, 25 bp, Homo sapiens
tctcccctggcttctcggagtacaa

SEQ ID NO: 14446 - DNA, 25 bp, Homo sapiens
ctcccctggcttctcggagtacaaa

SEQ ID NO: 14447 - DNA, 25 bp, Homo sapiens
tcccctggcttctcggagtacaaat

SEQ ID NO: 14448 - DNA, 25 bp, Homo sapiens
cccctggcttctcggagtacaaata

SEQ ID NO: 14449 - DNA, 25 bp, Homo sapiens
ccctggcttctcggagtacaaatac

SEQ ID NO: 14450 - DNA, 25 bp, Homo sapiens
cctggcttctcggagtacaaataca

SEQ ID NO: 14451 - DNA, 25 bp, Homo sapiens
ctggcttctcggagtacaaatacat

SEQ ID NO: 14452 - DNA, 25 bp, Homo sapiens
tggcttctcggagtacaaatacatc

SEQ ID NO: 14453 - DNA, 25 bp, Homo sapiens
ggcttctcggagtacaaatacatcc

SEQ ID NO: 14454 - DNA, 25 bp, Homo sapiens
gcttctcggagtacaaatacatccc

SEQ ID NO: 14455 - DNA, 25 bp, Homo sapiens
cttctcggagtacaaatacatcccc

SEQ ID NO: 14456 - DNA, 25 bp, Homo sapiens
ttctcggagtacaaatacatccccg

SEQ ID NO: 14457 - DNA, 25 bp, Homo sapiens
tctcggagtacaaatacatccccgc

SEQ ID NO: 14458 - DNA, 25 bp, Homo sapiens
ctcggagtacaaatacatccccgct

SEQ ID NO: 14459 - DNA, 25 bp, Homo sapiens
tcggagtacaaatacatccccgctg

SEQ ID NO: 14460 - DNA, 25 bp, Homo sapiens
cggagtacaaatacatccccgctgt

SEQ ID NO: 14461 - DNA, 25 bp, Homo sapiens
ggagtacaaatacatccccgctgtc

SEQ ID NO: 14462 - DNA, 25 bp, Homo sapiens
gagtacaaatacatccccgctgtcg

SEQ ID NO: 14463 - DNA, 25 bp, Homo sapiens
agtacaaatacatccccgctgtcga

SEQ ID NO: 14464 - DNA, 25 bp, Homo sapiens
gtacaaatacatccccgctgtcgag

SEQ ID NO: 14465 - DNA, 25 bp, Homo sapiens
tacaaatacatccccgctgtcgagg

SEQ ID NO: 14466 - DNA, 25 bp, Homo sapiens
acaaatacatccccgctgtcgaggg

SEQ ID NO: 14467 - DNA, 25 bp, Homo sapiens
caaatacatccccgctgtcgaggga

SEQ ID NO: 14468 - DNA, 25 bp, Homo sapiens
aaatacatccccgctgtcgagggaa

SEQ ID NO: 14469 - DNA, 25 bp, Homo sapiens
aatacatccccgctgtcgagggaaa

SEQ ID NO: 14470 - DNA, 25 bp, Homo sapiens
atacatccccgctgtcgagggaaaa

SEQ ID NO: 14471 - DNA, 25 bp, Homo sapiens
tacatccccgctgtcgagggaaaag

SEQ ID NO: 14472 - DNA, 25 bp, Homo sapiens
acatccccgctgtcgagggaaaagc

SEQ ID NO: 14473 - DNA, 25 bp, Homo sapiens
catccccgctgtcgagggaaaagct

SEQ ID NO: 14474 - DNA, 25 bp, Homo sapiens
atccccgctgtcgagggaaaagctg

SEQ ID NO: 14475 - DNA, 25 bp, Homo sapiens
tccccgctgtcgagggaaaagctgc

SEQ ID NO: 14476 - DNA, 25 bp, Homo sapiens
ccccgctgtcgagggaaaagctgcc

SEQ ID NO: 14477 - DNA, 25 bp, Homo sapiens
cccgctgtcgagggaaaagctgccc

SEQ ID NO: 14478 - DNA, 25 bp, Homo sapiens
ccgctgtcgagggaaaagctgccca

SEQ ID NO: 14479 - DNA, 25 bp, Homo sapiens
cgctgtcgagggaaaagctgcccag

SEQ ID NO: 14480 - DNA, 25 bp, Homo sapiens
gctgtcgagggaaaagctgcccagt

SEQ ID NO: 14481 - DNA, 25 bp, Homo sapiens
ctgtcgagggaaaagctgcccagtc

SEQ ID NO: 14482 - DNA, 25 bp, Homo sapiens
tgtcgagggaaaagctgcccagtcc

SEQ ID NO: 14483 - DNA, 25 bp, Homo sapiens
gtcgagggaaaagctgcccagtcct

SEQ ID NO: 14484 - DNA, 25 bp, Homo sapiens
tcgagggaaaagctgcccagtcctt

SEQ ID NO: 14485 - DNA, 25 bp, Homo sapiens
cgagggaaaagctgcccagtccttc

SEQ ID NO: 14486 - DNA, 25 bp, Homo sapiens
gagggaaaagctgcccagtccttca

SEQ ID NO: 14487 - DNA, 25 bp, Homo sapiens
agggaaaagctgcccagtccttcag

SEQ ID NO: 14488 - DNA, 25 bp, Homo sapiens
gggaaaagctgcccagtccttcagc

SEQ ID NO: 14489 - DNA, 25 bp, Homo sapiens
ggaaaagctgcccagtccttcagcg

SEQ ID NO: 14490 - DNA, 25 bp, Homo sapiens
gaaaagctgcccagtccttcagcgg

SEQ ID NO: 14491 - DNA, 25 bp, Homo sapiens
aaaagctgcccagtccttcagcggc

SEQ ID NO: 14492 - DNA, 25 bp, Homo sapiens
aaagctgcccagtccttcagcggcc

SEQ ID NO: 14493 - DNA, 25 bp, Homo sapiens
aagctgcccagtccttcagcggccc

SEQ ID NO: 14494 - DNA, 25 bp, Homo sapiens
agctgcccagtccttcagcggccct

SEQ ID NO: 14495 - DNA, 25 bp, Homo sapiens
gctgcccagtccttcagcggccctc

SEQ ID NO: 14496 - DNA, 25 bp, Homo sapiens
ctgcccagtccttcagcggccctct

SEQ ID NO: 14497 - DNA, 25 bp, Homo sapiens
tgcccagtccttcagcggccctctc

SEQ ID NO: 14498 - DNA, 25 bp, Homo sapiens
gcccagtccttcagcggccctctcg

SEQ ID NO: 14499 - DNA, 25 bp, Homo sapiens
cccagtccttcagcggccctctcgg

SEQ ID NO: 14500 - DNA, 25 bp, Homo sapiens
ccagtccttcagcggccctctcgga

SEQ ID NO: 14501 - DNA, 25 bp, Homo sapiens
cagtccttcagcggccctctcggag

SEQ ID NO: 14502 - DNA, 25 bp, Homo sapiens
agtccttcagcggccctctcggagt

SEQ ID NO: 14503 - DNA, 25 bp, Homo sapiens
gtccttcagcggccctctcggagtt

SEQ ID NO: 14504 - DNA, 25 bp, Homo sapiens
tccttcagcggccctctcggagttc

SEQ ID NO: 14505 - DNA, 25 bp, Homo sapiens
ccttcagcggccctctcggagttcg

SEQ ID NO: 14506 - DNA, 25 bp, Homo sapiens
cttcagcggccctctcggagttcgt

SEQ ID NO: 14507 - DNA, 25 bp, Homo sapiens
ttcagcggccctctcggagttcgtg

SEQ ID NO: 14508 - DNA, 25 bp, Homo sapiens
tcagcggccctctcggagttcgtgg

SEQ ID NO: 14509 - DNA, 25 bp, Homo sapiens
cagcggccctctcggagttcgtgga

SEQ ID NO: 14510 - DNA, 25 bp, Homo sapiens
agcggccctctcggagttcgtggaa

SEQ ID NO: 14511 - DNA, 25 bp, Homo sapiens
gcggccctctcggagttcgtggaag

SEQ ID NO: 14512 - DNA, 25 bp, Homo sapiens
cggccctctcggagttcgtggaagg

SEQ ID NO: 14513 - DNA, 25 bp, Homo sapiens
ggccctctcggagttcgtggaaggg

SEQ ID NO: 14514 - DNA, 25 bp, Homo sapiens
gccctctcggagttcgtggaagggc

SEQ ID NO: 14515 - DNA, 25 bp, Homo sapiens
ccctctcggagttcgtggaagggct

SEQ ID NO: 14516 - DNA, 25 bp, Homo sapiens
cctctcggagttcgtggaagggctc

SEQ ID NO: 14517 - DNA, 25 bp, Homo sapiens
ctctcggagttcgtggaagggctcc

SEQ ID NO: 14518 - DNA, 25 bp, Homo sapiens
tctcggagttcgtggaagggctccg

SEQ ID NO: 14519 - DNA, 25 bp, Homo sapiens
ctcggagttcgtggaagggctccgg

SEQ ID NO: 14520 - DNA, 25 bp, Homo sapiens
tcggagttcgtggaagggctccgga

SEQ ID NO: 14521 - DNA, 25 bp, Homo sapiens
cggagttcgtggaagggctccggag

SEQ ID NO: 14522 - DNA, 25 bp, Homo sapiens
ggagttcgtggaagggctccggagg

SEQ ID NO: 14523 - DNA, 25 bp, Homo sapiens
gagttcgtggaagggctccggagga

SEQ ID NO: 14524 - DNA, 25 bp, Homo sapiens
agttcgtggaagggctccggaggaa

SEQ ID NO: 14525 - DNA, 25 bp, Homo sapiens
gttcgtggaagggctccggaggaag

SEQ ID NO: 14526 - DNA, 25 bp, Homo sapiens
ttcgtggaagggctccggaggaaga

SEQ ID NO: 14527 - DNA, 25 bp, Homo sapiens
tcgtggaagggctccggaggaagag

SEQ ID NO: 14528 - DNA, 25 bp, Homo sapiens
cgtggaagggctccggaggaagaga

SEQ ID NO: 14529 - DNA, 25 bp, Homo sapiens
gtggaagggctccggaggaagagag

SEQ ID NO: 14530 - DNA, 25 bp, Homo sapiens
tggaagggctccggaggaagagagc

SEQ ID NO: 14531 - DNA, 25 bp, Homo sapiens
ggaagggctccggaggaagagagcc

SEQ ID NO: 14532 - DNA, 25 bp, Homo sapiens
gaagggctccggaggaagagagccc

SEQ ID NO: 14533 - DNA, 25 bp, Homo sapiens
aagggctccggaggaagagagccca

SEQ ID NO: 14534 - DNA, 25 bp, Homo sapiens
agggctccggaggaagagagcccag

SEQ ID NO: 14535 - DNA, 25 bp, Homo sapiens
gggctccggaggaagagagcccaga

SEQ ID NO: 14536 - DNA, 25 bp, Homo sapiens
ggctccggaggaagagagcccagag

SEQ ID NO: 14537 - DNA, 25 bp, Homo sapiens
gctccggaggaagagagcccagaga

SEQ ID NO: 14538 - DNA, 25 bp, Homo sapiens
ctccggaggaagagagcccagagag

SEQ ID NO: 14539 - DNA, 25 bp, Homo sapiens
tccggaggaagagagcccagagagg

SEQ ID NO: 14540 - DNA, 25 bp, Homo sapiens
ccggaggaagagagcccagagaggc

SEQ ID NO: 14541 - DNA, 25 bp, Homo sapiens
cggaggaagagagcccagagaggcc

SEQ ID NO: 14542 - DNA, 25 bp, Homo sapiens
ggaggaagagagcccagagaggcca

SEQ ID NO: 14543 - DNA, 25 bp, Homo sapiens
gaggaagagagcccagagaggccag

SEQ ID NO: 14544 - DNA, 25 bp, Homo sapiens
aggaagagagcccagagaggccagg

SEQ ID NO: 14545 - DNA, 25 bp, Homo sapiens
ggaagagagcccagagaggccaggg

SEQ ID NO: 14546 - DNA, 25 bp, Homo sapiens
gaagagagcccagagaggccagggg

SEQ ID NO: 14547 - DNA, 25 bp, Homo sapiens
aagagagcccagagaggccaggggt

SEQ ID NO: 14548 - DNA, 25 bp, Homo sapiens
agagagcccagagaggccaggggtc

SEQ ID NO: 14549 - DNA, 25 bp, Homo sapiens
gagagcccagagaggccaggggtcc

SEQ ID NO: 14550 - DNA, 25 bp, Homo sapiens
agagcccagagaggccaggggtcca

SEQ ID NO: 14551 - DNA, 25 bp, Homo sapiens
gagcccagagaggccaggggtccac

SEQ ID NO: 14552 - DNA, 25 bp, Homo sapiens
agcccagagaggccaggggtccacg

SEQ ID NO: 14553 - DNA, 25 bp, Homo sapiens
gcccagagaggccaggggtccacgc

SEQ ID NO: 14554 - DNA, 25 bp, Homo sapiens
cccagagaggccaggggtccacgct

SEQ ID NO: 14555 - DNA, 25 bp, Homo sapiens
ccagagaggccaggggtccacgctg

SEQ ID NO: 14556 - DNA, 25 bp, Homo sapiens
cagagaggccaggggtccacgctgg

SEQ ID NO: 14557 - DNA, 25 bp, Homo sapiens
agagaggccaggggtccacgctggg

SEQ ID NO: 14558 - DNA, 25 bp, Homo sapiens
gagaggccaggggtccacgctgggc

SEQ ID NO: 14559 - DNA, 25 bp, Homo sapiens
agaggccaggggtccacgctgggcc

SEQ ID NO: 14560 - DNA, 25 bp, Homo sapiens
gaggccaggggtccacgctgggcct

SEQ ID NO: 14561 - DNA, 25 bp, Homo sapiens
aggccaggggtccacgctgggccta

SEQ ID NO: 14562 - DNA, 25 bp, Homo sapiens
ggccaggggtccacgctgggcctag

SEQ ID NO: 14563 - DNA, 25 bp, Homo sapiens
gccaggggtccacgctgggcctaga

SEQ ID NO: 14564 - DNA, 25 bp, Homo sapiens
ccaggggtccacgctgggcctagag

SEQ ID NO: 14565 - DNA, 25 bp, Homo sapiens
caggggtccacgctgggcctagagg

SEQ ID NO: 14566 - DNA, 25 bp, Homo sapiens
aggggtccacgctgggcctagagga

SEQ ID NO: 14567 - DNA, 25 bp, Homo sapiens
ggggtccacgctgggcctagaggac

SEQ ID NO: 14568 - DNA, 25 bp, Homo sapiens
gggtccacgctgggcctagaggact

SEQ ID NO: 14569 - DNA, 25 bp, Homo sapiens
ggtccacgctgggcctagaggactg

SEQ ID NO: 14570 - DNA, 25 bp, Homo sapiens
gtccacgctgggcctagaggactgg

SEQ ID NO: 14571 - DNA, 25 bp, Homo sapiens
tccacgctgggcctagaggactggc

SEQ ID NO: 14572 - DNA, 25 bp, Homo sapiens
ccacgctgggcctagaggactggcc

SEQ ID NO: 14573 - DNA, 25 bp, Homo sapiens
cacgctgggcctagaggactggccc

SEQ ID NO: 14574 - DNA, 25 bp, Homo sapiens
acgctgggcctagaggactggccca

SEQ ID NO: 14575 - DNA, 25 bp, Homo sapiens
cgctgggcctagaggactggcccac

SEQ ID NO: 14576 - DNA, 25 bp, Homo sapiens
gctgggcctagaggactggcccact

SEQ ID NO: 14577 - DNA, 25 bp, Homo sapiens
ctgggcctagaggactggcccactc

SEQ ID NO: 14578 - DNA, 25 bp, Homo sapiens
tgggcctagaggactggcccactct

SEQ ID NO: 14579 - DNA, 25 bp, Homo sapiens
gggcctagaggactggcccactctc

SEQ ID NO: 14580 - DNA, 25 bp, Homo sapiens
ggcctagaggactggcccactctcc

SEQ ID NO: 14581 - DNA, 25 bp, Homo sapiens
gcctagaggactggcccactctccc

SEQ ID NO: 14582 - DNA, 25 bp, Homo sapiens
cctagaggactggcccactctcccc

SEQ ID NO: 14583 - DNA, 25 bp, Homo sapiens
ctagaggactggcccactctcccca

SEQ ID NO: 14584 - DNA, 25 bp, Homo sapiens
tagaggactggcccactctccccat

SEQ ID NO: 14585 - DNA, 25 bp, Homo sapiens
agaggactggcccactctccccatt

SEQ ID NO: 14586 - DNA, 25 bp, Homo sapiens
gaggactggcccactctccccattt

SEQ ID NO: 14587 - DNA, 25 bp, Homo sapiens
aggactggcccactctccccattta

SEQ ID NO: 14588 - DNA, 25 bp, Homo sapiens
ggactggcccactctccccatttac

SEQ ID NO: 14589 - DNA, 25 bp, Homo sapiens
gactggcccactctccccatttacc

SEQ ID NO: 14590 - DNA, 25 bp, Homo sapiens
actggcccactctccccatttacca

SEQ ID NO: 14591 - DNA, 25 bp, Homo sapiens
ctggcccactctccccatttaccag

SEQ ID NO: 14592 - DNA, 25 bp, Homo sapiens
tggcccactctccccatttaccaga

SEQ ID NO: 14593 - DNA, 25 bp, Homo sapiens
ggcccactctccccatttaccagac

SEQ ID NO: 14594 - DNA, 25 bp, Homo sapiens
gcccactctccccatttaccagacg

SEQ ID NO: 14595 - DNA, 25 bp, Homo sapiens
cccactctccccatttaccagacga

SEQ ID NO: 14596 - DNA, 25 bp, Homo sapiens
ccactctccccatttaccagacgac

SEQ ID NO: 14597 - DNA, 25 bp, Homo sapiens
cactctccccatttaccagacgact

SEQ ID NO: 14598 - DNA, 25 bp, Homo sapiens
actctccccatttaccagacgactg

SEQ ID NO: 14599 - DNA, 25 bp, Homo sapiens
ctctccccatttaccagacgactgg

SEQ ID NO: 14600 - DNA, 25 bp, Homo sapiens
tctccccatttaccagacgactggg

SEQ ID NO: 14601 - DNA, 25 bp, Homo sapiens
ctccccatttaccagacgactgggg

SEQ ID NO: 14602 - DNA, 25 bp, Homo sapiens
tccccatttaccagacgactggggc

SEQ ID NO: 14603 - DNA, 25 bp, Homo sapiens
ccccatttaccagacgactggggcc

SEQ ID NO: 14604 - DNA, 25 bp, Homo sapiens
cccatttaccagacgactggggcct

SEQ ID NO: 14605 - DNA, 25 bp, Homo sapiens
ccatttaccagacgactggggcctc

SEQ ID NO: 14606 - DNA, 25 bp, Homo sapiens
catttaccagacgactggggcctcc

SEQ ID NO: 14607 - DNA, 25 bp, Homo sapiens
atttaccagacgactggggcctcca

SEQ ID NO: 14608 - DNA, 25 bp, Homo sapiens
tttaccagacgactggggcctccac

SEQ ID NO: 14609 - DNA, 25 bp, Homo sapiens
ttaccagacgactggggcctccaca

SEQ ID NO: 14610 - DNA, 25 bp, Homo sapiens
taccagacgactggggcctccacac

SEQ ID NO: 14611 - DNA, 25 bp, Homo sapiens
accagacgactggggcctccacact

SEQ ID NO: 14612 - DNA, 25 bp, Homo sapiens
ccagacgactggggcctccacacta

SEQ ID NO: 14613 - DNA, 25 bp, Homo sapiens
cagacgactggggcctccacactaa

SEQ ID NO: 14614 - DNA, 25 bp, Homo sapiens
agacgactggggcctccacactaag

SEQ ID NO: 14615 - DNA, 25 bp, Homo sapiens
gacgactggggcctccacactaagg

SEQ ID NO: 14616 - DNA, 25 bp, Homo sapiens
acgactggggcctccacactaagga

SEQ ID NO: 14617 - DNA, 25 bp, Homo sapiens
cgactggggcctccacactaaggag

SEQ ID NO: 14618 - DNA, 25 bp, Homo sapiens
gactggggcctccacactaaggagg

SEQ ID NO: 14619 - DNA, 25 bp, Homo sapiens
actggggcctccacactaaggaggg

SEQ ID NO: 14620 - DNA, 25 bp, Homo sapiens
ctggggcctccacactaaggagggg

SEQ ID NO: 14621 - DNA, 25 bp, Homo sapiens
tggggcctccacactaaggaggggc

SEQ ID NO: 14622 - DNA, 25 bp, Homo sapiens
ggggcctccacactaaggaggggca

SEQ ID NO: 14623 - DNA, 25 bp, Homo sapiens
gggcctccacactaaggaggggcag

SEQ ID NO: 14624 - DNA, 25 bp, Homo sapiens
ggcctccacactaaggaggggcagg

SEQ ID NO: 14625 - DNA, 25 bp, Homo sapiens
gcctccacactaaggaggggcaggg

SEQ ID NO: 14626 - DNA, 25 bp, Homo sapiens
cctccacactaaggaggggcagggc

SEQ ID NO: 14627 - DNA, 25 bp, Homo sapiens
ctccacactaaggaggggcagggct

SEQ ID NO: 14628 - DNA, 25 bp, Homo sapiens
tccacactaaggaggggcagggctg

SEQ ID NO: 14629 - DNA, 25 bp, Homo sapiens
ccacactaaggaggggcagggctgg

SEQ ID NO: 14630 - DNA, 25 bp, Homo sapiens
cacactaaggaggggcagggctggc

SEQ ID NO: 14631 - DNA, 25 bp, Homo sapiens
acactaaggaggggcagggctggca

SEQ ID NO: 14632 - DNA, 25 bp, Homo sapiens
cactaaggaggggcagggctggcag

SEQ ID NO: 14633 - DNA, 25 bp, Homo sapiens
actaaggaggggcagggctggcagt

SEQ ID NO: 14634 - DNA, 25 bp, Homo sapiens
ctaaggaggggcagggctggcagtg

SEQ ID NO: 14635 - DNA, 25 bp, Homo sapiens
taaggaggggcagggctggcagtga

SEQ ID NO: 14636 - DNA, 25 bp, Homo sapiens
aaggaggggcagggctggcagtgac

SEQ ID NO: 14637 - DNA, 25 bp, Homo sapiens
aggaggggcagggctggcagtgacg

SEQ ID NO: 14638 - DNA, 25 bp, Homo sapiens
ggaggggcagggctggcagtgacga

SEQ ID NO: 14639 - DNA, 25 bp, Homo sapiens
gaggggcagggctggcagtgacgag

SEQ ID NO: 14640 - DNA, 25 bp, Homo sapiens
aggggcagggctggcagtgacgagg

SEQ ID NO: 14641 - DNA, 25 bp, Homo sapiens
ggggcagggctggcagtgacgaggg

SEQ ID NO: 14642 - DNA, 25 bp, Homo sapiens
gggcagggctggcagtgacgaggga

SEQ ID NO: 14643 - DNA, 25 bp, Homo sapiens
ggcagggctggcagtgacgagggaa

SEQ ID NO: 14644 - DNA, 25 bp, Homo sapiens
gcagggctggcagtgacgagggaaa

SEQ ID NO: 14645 - DNA, 25 bp, Homo sapiens
cagggctggcagtgacgagggaaac

SEQ ID NO: 14646 - DNA, 25 bp, Homo sapiens
agggctggcagtgacgagggaaacc

SEQ ID NO: 14647 - DNA, 25 bp, Homo sapiens
gggctggcagtgacgagggaaacct

SEQ ID NO: 14648 - DNA, 25 bp, Homo sapiens
ggctggcagtgacgagggaaacctc

SEQ ID NO: 14649 - DNA, 25 bp, Homo sapiens
gctggcagtgacgagggaaacctct

SEQ ID NO: 14650 - DNA, 25 bp, Homo sapiens
ctggcagtgacgagggaaacctctc

SEQ ID NO: 14651 - DNA, 25 bp, Homo sapiens
tggcagtgacgagggaaacctctcg

SEQ ID NO: 14652 - DNA, 25 bp, Homo sapiens
ggcagtgacgagggaaacctctcgc

SEQ ID NO: 14653 - DNA, 25 bp, Homo sapiens
gcagtgacgagggaaacctctcgct

SEQ ID NO: 14654 - DNA, 25 bp, Homo sapiens
cagtgacgagggaaacctctcgctg

SEQ ID NO: 14655 - DNA, 25 bp, Homo sapiens
agtgacgagggaaacctctcgctga

SEQ ID NO: 14656 - DNA, 25 bp, Homo sapiens
gtgacgagggaaacctctcgctgag

SEQ ID NO: 14657 - DNA, 25 bp, Homo sapiens
tgacgagggaaacctctcgctgagg

SEQ ID NO: 14658 - DNA, 25 bp, Homo sapiens
gacgagggaaacctctcgctgaggg

SEQ ID NO: 14659 - DNA, 25 bp, Homo sapiens
acgagggaaacctctcgctgagggt

SEQ ID NO: 14660 - DNA, 25 bp, Homo sapiens
cgagggaaacctctcgctgagggtt

SEQ ID NO: 14661 - DNA, 25 bp, Homo sapiens
gagggaaacctctcgctgagggttg

SEQ ID NO: 14662 - DNA, 25 bp, Homo sapiens
agggaaacctctcgctgagggttgg

SEQ ID NO: 14663 - DNA, 25 bp, Homo sapiens
gggaaacctctcgctgagggttggg

SEQ ID NO: 14664 - DNA, 25 bp, Homo sapiens
ggaaacctctcgctgagggttgggg

SEQ ID NO: 14665 - DNA, 25 bp, Homo sapiens
gaaacctctcgctgagggttggggc

SEQ ID NO: 14666 - DNA, 25 bp, Homo sapiens
aaacctctcgctgagggttggggca

SEQ ID NO: 14667 - DNA, 25 bp, Homo sapiens
aacctctcgctgagggttggggcaa

SEQ ID NO: 14668 - DNA, 25 bp, Homo sapiens
acctctcgctgagggttggggcaaa

SEQ ID NO: 14669 - DNA, 25 bp, Homo sapiens
cctctcgctgagggttggggcaaag

SEQ ID NO: 14670 - DNA, 25 bp, Homo sapiens
ctctcgctgagggttggggcaaagt

SEQ ID NO: 14671 - DNA, 25 bp, Homo sapiens
tctcgctgagggttggggcaaagtc

SEQ ID NO: 14672 - DNA, 25 bp, Homo sapiens
ctcgctgagggttggggcaaagtca

SEQ ID NO: 14673 - DNA, 25 bp, Homo sapiens
tcgctgagggttggggcaaagtcac

SEQ ID NO: 14674 - DNA, 25 bp, Homo sapiens
cgctgagggttggggcaaagtcacc

SEQ ID NO: 14675 - DNA, 25 bp, Homo sapiens
gctgagggttggggcaaagtcaccc

SEQ ID NO: 14676 - DNA, 25 bp, Homo sapiens
ctgagggttggggcaaagtcacccc

SEQ ID NO: 14677 - DNA, 25 bp, Homo sapiens
tgagggttggggcaaagtcacccct

SEQ ID NO: 14678 - DNA, 25 bp, Homo sapiens
gagggttggggcaaagtcacccctg

SEQ ID NO: 14679 - DNA, 25 bp, Homo sapiens
agggttggggcaaagtcacccctgg

SEQ ID NO: 14680 - DNA, 25 bp, Homo sapiens
gggttggggcaaagtcacccctgga

SEQ ID NO: 14681 - DNA, 25 bp, Homo sapiens
ggttggggcaaagtcacccctggaa

SEQ ID NO: 14682 - DNA, 25 bp, Homo sapiens
gttggggcaaagtcacccctggaaa

SEQ ID NO: 14683 - DNA, 25 bp, Homo sapiens
ttggggcaaagtcacccctggaaat

SEQ ID NO: 14684 - DNA, 25 bp, Homo sapiens
tggggcaaagtcacccctggaaatc

SEQ ID NO: 14685 - DNA, 25 bp, Homo sapiens
ggggcaaagtcacccctggaaatcg

SEQ ID NO: 14686 - DNA, 25 bp, Homo sapiens
gggcaaagtcacccctggaaatcga

SEQ ID NO: 14687 - DNA, 25 bp, Homo sapiens
ggcaaagtcacccctggaaatcgaa

SEQ ID NO: 14688 - DNA, 25 bp, Homo sapiens
gcaaagtcacccctggaaatcgaag

SEQ ID NO: 14689 - DNA, 25 bp, Homo sapiens
caaagtcacccctggaaatcgaagg

SEQ ID NO: 14690 - DNA, 25 bp, Homo sapiens
aaagtcacccctggaaatcgaaggg

SEQ ID NO: 14691 - DNA, 25 bp, Homo sapiens
aagtcacccctggaaatcgaagggg

SEQ ID NO: 14692 - DNA, 25 bp, Homo sapiens
agtcacccctggaaatcgaaggggc

SEQ ID NO: 14693 - DNA, 25 bp, Homo sapiens
gtcacccctggaaatcgaaggggcc

SEQ ID NO: 14694 - DNA, 25 bp, Homo sapiens
tcacccctggaaatcgaaggggccg

SEQ ID NO: 14695 - DNA, 25 bp, Homo sapiens
cacccctggaaatcgaaggggccgc

SEQ ID NO: 14696 - DNA, 25 bp, Homo sapiens
acccctggaaatcgaaggggccgct

SEQ ID NO: 14697 - DNA, 25 bp, Homo sapiens
cccctggaaatcgaaggggccgctg

SEQ ID NO: 14698 - DNA, 25 bp, Homo sapiens
ccctggaaatcgaaggggccgctgg

SEQ ID NO: 14699 - DNA, 25 bp, Homo sapiens
cctggaaatcgaaggggccgctggt

SEQ ID NO: 14700 - DNA, 25 bp, Homo sapiens
ctggaaatcgaaggggccgctggtg

SEQ ID NO: 14701 - DNA, 25 bp, Homo sapiens
tggaaatcgaaggggccgctggtgg

SEQ ID NO: 14702 - DNA, 25 bp, Homo sapiens
ggaaatcgaaggggccgctggtggt

SEQ ID NO: 14703 - DNA, 25 bp, Homo sapiens
gaaatcgaaggggccgctggtggtc

SEQ ID NO: 14704 - DNA, 25 bp, Homo sapiens
aaatcgaaggggccgctggtggtct

SEQ ID NO: 14705 - DNA, 25 bp, Homo sapiens
aatcgaaggggccgctggtggtctc

SEQ ID NO: 14706 - DNA, 25 bp, Homo sapiens
atcgaaggggccgctggtggtctct

SEQ ID NO: 14707 - DNA, 25 bp, Homo sapiens
tcgaaggggccgctggtggtctctt

SEQ ID NO: 14708 - DNA, 25 bp, Homo sapiens
cgaaggggccgctggtggtctcttg

SEQ ID NO: 14709 - DNA, 25 bp, Homo sapiens
gaaggggccgctggtggtctcttga

SEQ ID NO: 14710 - DNA, 25 bp, Homo sapiens
aaggggccgctggtggtctcttgag

SEQ ID NO: 14711 - DNA, 25 bp, Homo sapiens
aggggccgctggtggtctcttgagg

SEQ ID NO: 14712 - DNA, 25 bp, Homo sapiens
ggggccgctggtggtctcttgaggt

SEQ ID NO: 14713 - DNA, 25 bp, Homo sapiens
gggccgctggtggtctcttgaggtc

SEQ ID NO: 14714 - DNA, 25 bp, Homo sapiens
ggccgctggtggtctcttgaggtcc

SEQ ID NO: 14715 - DNA, 25 bp, Homo sapiens
gccgctggtggtctcttgaggtcca

SEQ ID NO: 14716 - DNA, 25 bp, Homo sapiens
ccgctggtggtctcttgaggtccac

SEQ ID NO: 14717 - DNA, 25 bp, Homo sapiens
cgctggtggtctcttgaggtccacc

SEQ ID NO: 14718 - DNA, 25 bp, Homo sapiens
gctggtggtctcttgaggtccacca

SEQ ID NO: 14719 - DNA, 25 bp, Homo sapiens
ctggtggtctcttgaggtccaccag

SEQ ID NO: 14720 - DNA, 25 bp, Homo sapiens
tggtggtctcttgaggtccaccagc

SEQ ID NO: 14721 - DNA, 25 bp, Homo sapiens
ggtggtctcttgaggtccaccagcc

SEQ ID NO: 14722 - DNA, 25 bp, Homo sapiens
gtggtctcttgaggtccaccagcct

SEQ ID NO: 14723 - DNA, 25 bp, Homo sapiens
tggtctcttgaggtccaccagcctc

SEQ ID NO: 14724 - DNA, 25 bp, Homo sapiens
ggtctcttgaggtccaccagcctca

SEQ ID NO: 14725 - DNA, 25 bp, Homo sapiens
gtctcttgaggtccaccagcctcaa

SEQ ID NO: 14726 - DNA, 25 bp, Homo sapiens
tctcttgaggtccaccagcctcaaa

SEQ ID NO: 14727 - DNA, 25 bp, Homo sapiens
ctcttgaggtccaccagcctcaaat

SEQ ID NO: 14728 - DNA, 25 bp, Homo sapiens
tcttgaggtccaccagcctcaaatg

SEQ ID NO: 14729 - DNA, 25 bp, Homo sapiens
cttgaggtccaccagcctcaaatgc

SEQ ID NO: 14730 - DNA, 25 bp, Homo sapiens
ttgaggtccaccagcctcaaatgca

SEQ ID NO: 14731 - DNA, 25 bp, Homo sapiens
tgaggtccaccagcctcaaatgcat

SEQ ID NO: 14732 - DNA, 25 bp, Homo sapiens
gaggtccaccagcctcaaatgcatc

SEQ ID NO: 14733 - DNA, 25 bp, Homo sapiens
aggtccaccagcctcaaatgcatct

SEQ ID NO: 14734 - DNA, 25 bp, Homo sapiens
ggtccaccagcctcaaatgcatctc

SEQ ID NO: 14735 - DNA, 25 bp, Homo sapiens
gtccaccagcctcaaatgcatctct

SEQ ID NO: 14736 - DNA, 25 bp, Homo sapiens
tccaccagcctcaaatgcatctctt

SEQ ID NO: 14737 - DNA, 25 bp, Homo sapiens
ccaccagcctcaaatgcatctcttc

SEQ ID NO: 14738 - DNA, 25 bp, Homo sapiens
caccagcctcaaatgcatctcttca

SEQ ID NO: 14739 - DNA, 25 bp, Homo sapiens
accagcctcaaatgcatctcttcag

SEQ ID NO: 14740 - DNA, 25 bp, Homo sapiens
ccagcctcaaatgcatctcttcaga

SEQ ID NO: 14741 - DNA, 25 bp, Homo sapiens
cagcctcaaatgcatctcttcagac

SEQ ID NO: 14742 - DNA, 25 bp, Homo sapiens
agcctcaaatgcatctcttcagacg

SEQ ID NO: 14743 - DNA, 25 bp, Homo sapiens
gcctcaaatgcatctcttcagacgg

SEQ ID NO: 14744 - DNA, 25 bp, Homo sapiens
cctcaaatgcatctcttcagacggt

SEQ ID NO: 14745 - DNA, 25 bp, Homo sapiens
ctcaaatgcatctcttcagacggtg

SEQ ID NO: 14746 - DNA, 25 bp, Homo sapiens
tcaaatgcatctcttcagacggtgt

SEQ ID NO: 14747 - DNA, 25 bp, Homo sapiens
caaatgcatctcttcagacggtgtt

SEQ ID NO: 14748 - DNA, 25 bp, Homo sapiens
aaatgcatctcttcagacggtgttg

SEQ ID NO: 14749 - DNA, 25 bp, Homo sapiens
aatgcatctcttcagacggtgttgg

SEQ ID NO: 14750 - DNA, 25 bp, Homo sapiens
atgcatctcttcagacggtgttggg

SEQ ID NO: 14751 - DNA, 25 bp, Homo sapiens
tgcatctcttcagacggtgttgggg

SEQ ID NO: 14752 - DNA, 25 bp, Homo sapiens
gcatctcttcagacggtgttggggg

SEQ ID NO: 14753 - DNA, 25 bp, Homo sapiens
catctcttcagacggtgttgggggc

SEQ ID NO: 14754 - DNA, 25 bp, Homo sapiens
atctcttcagacggtgttgggggca

SEQ ID NO: 14755 - DNA, 25 bp, Homo sapiens
tctcttcagacggtgttgggggcac

SEQ ID NO: 14756 - DNA, 25 bp, Homo sapiens
ctcttcagacggtgttgggggcaca

SEQ ID NO: 14757 - DNA, 25 bp, Homo sapiens
tcttcagacggtgttgggggcacaa

SEQ ID NO: 14758 - DNA, 25 bp, Homo sapiens
cttcagacggtgttgggggcacaac

SEQ ID NO: 14759 - DNA, 25 bp, Homo sapiens
ttcagacggtgttgggggcacaacc

SEQ ID NO: 14760 - DNA, 25 bp, Homo sapiens
tcagacggtgttgggggcacaaccc

SEQ ID NO: 14761 - DNA, 25 bp, Homo sapiens
cagacggtgttgggggcacaaccct

SEQ ID NO: 14762 - DNA, 25 bp, Homo sapiens
agacggtgttgggggcacaacccta

SEQ ID NO: 14763 - DNA, 25 bp, Homo sapiens
gacggtgttgggggcacaaccctac

SEQ ID NO: 14764 - DNA, 25 bp, Homo sapiens
acggtgttgggggcacaaccctact

SEQ ID NO: 14765 - DNA, 25 bp, Homo sapiens
cggtgttgggggcacaaccctactc

SEQ ID NO: 14766 - DNA, 25 bp, Homo sapiens
ggtgttgggggcacaaccctactcc

SEQ ID NO: 14767 - DNA, 25 bp, Homo sapiens
gtgttgggggcacaaccctactccc

SEQ ID NO: 14768 - DNA, 25 bp, Homo sapiens
tgttgggggcacaaccctactcccc

SEQ ID NO: 14769 - DNA, 25 bp, Homo sapiens
gttgggggcacaaccctactccccg

SEQ ID NO: 14770 - DNA, 25 bp, Homo sapiens
ttgggggcacaaccctactccccga

SEQ ID NO: 14771 - DNA, 25 bp, Homo sapiens
tgggggcacaaccctactccccgaa

SEQ ID NO: 14772 - DNA, 25 bp, Homo sapiens
gggggcacaaccctactccccgaaa

SEQ ID NO: 14773 - DNA, 25 bp, Homo sapiens
ggggcacaaccctactccccgaaaa

SEQ ID NO: 14774 - DNA, 25 bp, Homo sapiens
gggcacaaccctactccccgaaaag

SEQ ID NO: 14775 - DNA, 25 bp, Homo sapiens
ggcacaaccctactccccgaaaagt

SEQ ID NO: 14776 - DNA, 25 bp, Homo sapiens
gcacaaccctactccccgaaaagtc

SEQ ID NO: 14777 - DNA, 25 bp, Homo sapiens
cacaaccctactccccgaaaagtcg

SEQ ID NO: 14778 - DNA, 25 bp, Homo sapiens
acaaccctactccccgaaaagtcga

SEQ ID NO: 14779 - DNA, 25 bp, Homo sapiens
caaccctactccccgaaaagtcgaa

SEQ ID NO: 14780 - DNA, 25 bp, Homo sapiens
aaccctactccccgaaaagtcgaaa

SEQ ID NO: 14781 - DNA, 25 bp, Homo sapiens
accctactccccgaaaagtcgaaaa

SEQ ID NO: 14782 - DNA, 25 bp, Homo sapiens
ccctactccccgaaaagtcgaaaac

SEQ ID NO: 14783 - DNA, 25 bp, Homo sapiens
cctactccccgaaaagtcgaaaacc

SEQ ID NO: 14784 - DNA, 25 bp, Homo sapiens
ctactccccgaaaagtcgaaaaccc

SEQ ID NO: 14785 - DNA, 25 bp, Homo sapiens
tactccccgaaaagtcgaaaaccca

SEQ ID NO: 14786 - DNA, 25 bp, Homo sapiens
actccccgaaaagtcgaaaacccaa

SEQ ID NO: 14787 - DNA, 25 bp, Homo sapiens
ctccccgaaaagtcgaaaacccaat

SEQ ID NO: 14788 - DNA, 25 bp, Homo sapiens
tccccgaaaagtcgaaaacccaatt

SEQ ID NO: 14789 - DNA, 25 bp, Homo sapiens
ccccgaaaagtcgaaaacccaattc

SEQ ID NO: 14790 - DNA, 25 bp, Homo sapiens
cccgaaaagtcgaaaacccaattca

SEQ ID NO: 14791 - DNA, 25 bp, Homo sapiens
ccgaaaagtcgaaaacccaattcag

SEQ ID NO: 14792 - DNA, 25 bp, Homo sapiens
cgaaaagtcgaaaacccaattcagt

SEQ ID NO: 14793 - DNA, 25 bp, Homo sapiens
gaaaagtcgaaaacccaattcagtt

SEQ ID NO: 14794 - DNA, 25 bp, Homo sapiens
aaaagtcgaaaacccaattcagttc

SEQ ID NO: 14795 - DNA, 25 bp, Homo sapiens
aaagtcgaaaacccaattcagttcc

SEQ ID NO: 14796 - DNA, 25 bp, Homo sapiens
aagtcgaaaacccaattcagttcct

SEQ ID NO: 14797 - DNA, 25 bp, Homo sapiens
agtcgaaaacccaattcagttcctg

SEQ ID NO: 14798 - DNA, 25 bp, Homo sapiens
gtcgaaaacccaattcagttcctgc

SEQ ID NO: 14799 - DNA, 25 bp, Homo sapiens
tcgaaaacccaattcagttcctgcg

SEQ ID NO: 14800 - DNA, 25 bp, Homo sapiens
cgaaaacccaattcagttcctgcga

SEQ ID NO: 14801 - DNA, 25 bp, Homo sapiens
gaaaacccaattcagttcctgcgag

SEQ ID NO: 14802 - DNA, 25 bp, Homo sapiens
aaaacccaattcagttcctgcgagt

SEQ ID NO: 14803 - DNA, 25 bp, Homo sapiens
aaacccaattcagttcctgcgagtc

SEQ ID NO: 14804 - DNA, 25 bp, Homo sapiens
aacccaattcagttcctgcgagtcc

SEQ ID NO: 14805 - DNA, 25 bp, Homo sapiens
acccaattcagttcctgcgagtccc

SEQ ID NO: 14806 - DNA, 25 bp, Homo sapiens
cccaattcagttcctgcgagtccct

SEQ ID NO: 14807 - DNA, 25 bp, Homo sapiens
ccaattcagttcctgcgagtccctc

SEQ ID NO: 14808 - DNA, 25 bp, Homo sapiens
caattcagttcctgcgagtccctct

SEQ ID NO: 14809 - DNA, 25 bp, Homo sapiens
aattcagttcctgcgagtccctctt

SEQ ID NO: 14810 - DNA, 25 bp, Homo sapiens
attcagttcctgcgagtccctctta

SEQ ID NO: 14811 - DNA, 25 bp, Homo sapiens
ttcagttcctgcgagtccctcttag

SEQ ID NO: 14812 - DNA, 25 bp, Homo sapiens
tcagttcctgcgagtccctcttaga

SEQ ID NO: 14813 - DNA, 25 bp, Homo sapiens
cagttcctgcgagtccctcttagaa

SEQ ID NO: 14814 - DNA, 25 bp, Homo sapiens
agttcctgcgagtccctcttagaat

SEQ ID NO: 14815 - DNA, 25 bp, Homo sapiens
gttcctgcgagtccctcttagaatc

SEQ ID NO: 14816 - DNA, 25 bp, Homo sapiens
ttcctgcgagtccctcttagaatcc

SEQ ID NO: 14817 - DNA, 25 bp, Homo sapiens
tcctgcgagtccctcttagaatcca

SEQ ID NO: 14818 - DNA, 25 bp, Homo sapiens
cctgcgagtccctcttagaatccag

SEQ ID NO: 14819 - DNA, 25 bp, Homo sapiens
ctgcgagtccctcttagaatccaga

SEQ ID NO: 14820 - DNA, 25 bp, Homo sapiens
tgcgagtccctcttagaatccagac

SEQ ID NO: 14821 - DNA, 25 bp, Homo sapiens
gcgagtccctcttagaatccagacc

SEQ ID NO: 14822 - DNA, 25 bp, Homo sapiens
cgagtccctcttagaatccagaccg

SEQ ID NO: 14823 - DNA, 25 bp, Homo sapiens
gagtccctcttagaatccagaccga

SEQ ID NO: 14824 - DNA, 25 bp, Homo sapiens
agtccctcttagaatccagaccgag

SEQ ID NO: 14825 - DNA, 25 bp, Homo sapiens
gtccctcttagaatccagaccgagc

SEQ ID NO: 14826 - DNA, 25 bp, Homo sapiens
tccctcttagaatccagaccgagca

SEQ ID NO: 14827 - DNA, 25 bp, Homo sapiens
ccctcttagaatccagaccgagcat

SEQ ID NO: 14828 - DNA, 25 bp, Homo sapiens
cctcttagaatccagaccgagcatg

SEQ ID NO: 14829 - DNA, 25 bp, Homo sapiens
ctcttagaatccagaccgagcatgg

SEQ ID NO: 14830 - DNA, 25 bp, Homo sapiens
tcttagaatccagaccgagcatggg

SEQ ID NO: 14831 - DNA, 25 bp, Homo sapiens
cttagaatccagaccgagcatgggg

SEQ ID NO: 14832 - DNA, 25 bp, Homo sapiens
ttagaatccagaccgagcatgggga

SEQ ID NO: 14833 - DNA, 25 bp, Homo sapiens
tagaatccagaccgagcatggggag

SEQ ID NO: 14834 - DNA, 25 bp, Homo sapiens
agaatccagaccgagcatggggaga

SEQ ID NO: 14835 - DNA, 25 bp, Homo sapiens
gaatccagaccgagcatggggagaa

SEQ ID NO: 14836 - DNA, 25 bp, Homo sapiens
aatccagaccgagcatggggagaaa

SEQ ID NO: 14837 - DNA, 25 bp, Homo sapiens
atccagaccgagcatggggagaaaa

SEQ ID NO: 14838 - DNA, 25 bp, Homo sapiens
tccagaccgagcatggggagaaaac

SEQ ID NO: 14839 - DNA, 25 bp, Homo sapiens
ccagaccgagcatggggagaaaact

SEQ ID NO: 14840 - DNA, 25 bp, Homo sapiens
cagaccgagcatggggagaaaactg

SEQ ID NO: 14841 - DNA, 25 bp, Homo sapiens
agaccgagcatggggagaaaactga

SEQ ID NO: 14842 - DNA, 25 bp, Homo sapiens
gaccgagcatggggagaaaactgag

SEQ ID NO: 14843 - DNA, 25 bp, Homo sapiens
accgagcatggggagaaaactgagc

SEQ ID NO: 14844 - DNA, 25 bp, Homo sapiens
ccgagcatggggagaaaactgagct

SEQ ID NO: 14845 - DNA, 25 bp, Homo sapiens
cgagcatggggagaaaactgagctc

SEQ ID NO: 14846 - DNA, 25 bp, Homo sapiens
gagcatggggagaaaactgagctct

SEQ ID NO: 14847 - DNA, 25 bp, Homo sapiens
agcatggggagaaaactgagctctc

SEQ ID NO: 14848 - DNA, 25 bp, Homo sapiens
gcatggggagaaaactgagctctcc

SEQ ID NO: 14849 - DNA, 25 bp, Homo sapiens
catggggagaaaactgagctctccg

SEQ ID NO: 14850 - DNA, 25 bp, Homo sapiens
atggggagaaaactgagctctccga

SEQ ID NO: 14851 - DNA, 25 bp, Homo sapiens
tggggagaaaactgagctctccgac

SEQ ID NO: 14852 - DNA, 25 bp, Homo sapiens
ggggagaaaactgagctctccgacc

SEQ ID NO: 14853 - DNA, 25 bp, Homo sapiens
gggagaaaactgagctctccgacca

SEQ ID NO: 14854 - DNA, 25 bp, Homo sapiens
ggagaaaactgagctctccgaccac

SEQ ID NO: 14855 - DNA, 25 bp, Homo sapiens
gagaaaactgagctctccgaccaca

SEQ ID NO: 14856 - DNA, 25 bp, Homo sapiens
agaaaactgagctctccgaccacac

SEQ ID NO: 14857 - DNA, 25 bp, Homo sapiens
gaaaactgagctctccgaccacacc

SEQ ID NO: 14858 - DNA, 25 bp, Homo sapiens
aaaactgagctctccgaccacaccc

SEQ ID NO: 14859 - DNA, 25 bp, Homo sapiens
aaactgagctctccgaccacaccca

SEQ ID NO: 14860 - DNA, 25 bp, Homo sapiens
aactgagctctccgaccacacccag

SEQ ID NO: 14861 - DNA, 25 bp, Homo sapiens
actgagctctccgaccacacccagg

SEQ ID NO: 14862 - DNA, 25 bp, Homo sapiens
ctgagctctccgaccacacccaggg

SEQ ID NO: 14863 - DNA, 25 bp, Homo sapiens
tgagctctccgaccacacccaggga

SEQ ID NO: 14864 - DNA, 25 bp, Homo sapiens
gagctctccgaccacacccagggac

SEQ ID NO: 14865 - DNA, 25 bp, Homo sapiens
agctctccgaccacacccagggaca

SEQ ID NO: 14866 - DNA, 25 bp, Homo sapiens
gctctccgaccacacccagggacat

SEQ ID NO: 14867 - DNA, 25 bp, Homo sapiens
ctctccgaccacacccagggacatg

SEQ ID NO: 14868 - DNA, 25 bp, Homo sapiens
tctccgaccacacccagggacatgc

SEQ ID NO: 14869 - DNA, 25 bp, Homo sapiens
ctccgaccacacccagggacatgct

SEQ ID NO: 14870 - DNA, 25 bp, Homo sapiens
tccgaccacacccagggacatgctg

SEQ ID NO: 14871 - DNA, 25 bp, Homo sapiens
ccgaccacacccagggacatgctgt

SEQ ID NO: 14872 - DNA, 25 bp, Homo sapiens
cgaccacacccagggacatgctgtt

SEQ ID NO: 14873 - DNA, 25 bp, Homo sapiens
gaccacacccagggacatgctgttg

SEQ ID NO: 14874 - DNA, 25 bp, Homo sapiens
accacacccagggacatgctgttgt

SEQ ID NO: 14875 - DNA, 25 bp, Homo sapiens
ccacacccagggacatgctgttgtc

SEQ ID NO: 14876 - DNA, 25 bp, Homo sapiens
cacacccagggacatgctgttgtcg

SEQ ID NO: 14877 - DNA, 25 bp, Homo sapiens
acacccagggacatgctgttgtcgc

SEQ ID NO: 14878 - DNA, 25 bp, Homo sapiens
cacccagggacatgctgttgtcgcc

SEQ ID NO: 14879 - DNA, 25 bp, Homo sapiens
acccagggacatgctgttgtcgccc

SEQ ID NO: 14880 - DNA, 25 bp, Homo sapiens
cccagggacatgctgttgtcgccca

SEQ ID NO: 14881 - DNA, 25 bp, Homo sapiens
ccagggacatgctgttgtcgcccac

SEQ ID NO: 14882 - DNA, 25 bp, Homo sapiens
cagggacatgctgttgtcgcccaca

SEQ ID NO: 14883 - DNA, 25 bp, Homo sapiens
agggacatgctgttgtcgcccacac

SEQ ID NO: 14884 - DNA, 25 bp, Homo sapiens
gggacatgctgttgtcgcccacact

SEQ ID NO: 14885 - DNA, 25 bp, Homo sapiens
ggacatgctgttgtcgcccacactg

SEQ ID NO: 14886 - DNA, 25 bp, Homo sapiens
gacatgctgttgtcgcccacactgc

SEQ ID NO: 14887 - DNA, 25 bp, Homo sapiens
acatgctgttgtcgcccacactgcg

SEQ ID NO: 14888 - DNA, 25 bp, Homo sapiens
catgctgttgtcgcccacactgcgt

SEQ ID NO: 14889 - DNA, 25 bp, Homo sapiens
atgctgttgtcgcccacactgcgtc

SEQ ID NO: 14890 - DNA, 25 bp, Homo sapiens
tgctgttgtcgcccacactgcgtcc

SEQ ID NO: 14891 - DNA, 25 bp, Homo sapiens
gctgttgtcgcccacactgcgtcct

SEQ ID NO: 14892 - DNA, 25 bp, Homo sapiens
ctgttgtcgcccacactgcgtcctc

SEQ ID NO: 14893 - DNA, 25 bp, Homo sapiens
tgttgtcgcccacactgcgtcctcg

SEQ ID NO: 14894 - DNA, 25 bp, Homo sapiens
gttgtcgcccacactgcgtcctcgg

SEQ ID NO: 14895 - DNA, 25 bp, Homo sapiens
ttgtcgcccacactgcgtcctcgga

SEQ ID NO: 14896 - DNA, 25 bp, Homo sapiens
tgtcgcccacactgcgtcctcggag

SEQ ID NO: 14897 - DNA, 25 bp, Homo sapiens
gtcgcccacactgcgtcctcggagg

SEQ ID NO: 14898 - DNA, 25 bp, Homo sapiens
tcgcccacactgcgtcctcggaggc

SEQ ID NO: 14899 - DNA, 25 bp, Homo sapiens
cgcccacactgcgtcctcggaggcg

SEQ ID NO: 14900 - DNA, 25 bp, Homo sapiens
gcccacactgcgtcctcggaggcgg

SEQ ID NO: 14901 - DNA, 25 bp, Homo sapiens
cccacactgcgtcctcggaggcggt

SEQ ID NO: 14902 - DNA, 25 bp, Homo sapiens
ccacactgcgtcctcggaggcggtg

SEQ ID NO: 14903 - DNA, 25 bp, Homo sapiens
cacactgcgtcctcggaggcggtgt

SEQ ID NO: 14904 - DNA, 25 bp, Homo sapiens
acactgcgtcctcggaggcggtgtc

SEQ ID NO: 14905 - DNA, 25 bp, Homo sapiens
cactgcgtcctcggaggcggtgtct

SEQ ID NO: 14906 - DNA, 25 bp, Homo sapiens
actgcgtcctcggaggcggtgtctg

SEQ ID NO: 14907 - DNA, 25 bp, Homo sapiens
ctgcgtcctcggaggcggtgtctgg

SEQ ID NO: 14908 - DNA, 25 bp, Homo sapiens
tgcgtcctcggaggcggtgtctgga

SEQ ID NO: 14909 - DNA, 25 bp, Homo sapiens
gcgtcctcggaggcggtgtctggag

SEQ ID NO: 14910 - DNA, 25 bp, Homo sapiens
cgtcctcggaggcggtgtctggagt

SEQ ID NO: 14911 - DNA, 25 bp, Homo sapiens
gtcctcggaggcggtgtctggagtc

SEQ ID NO: 14912 - DNA, 25 bp, Homo sapiens
tcctcggaggcggtgtctggagtcc

SEQ ID NO: 14913 - DNA, 25 bp, Homo sapiens
cctcggaggcggtgtctggagtcct

SEQ ID NO: 14914 - DNA, 25 bp, Homo sapiens
ctcggaggcggtgtctggagtcctc

SEQ ID NO: 14915 - DNA, 25 bp, Homo sapiens
tcggaggcggtgtctggagtcctct

SEQ ID NO: 14916 - DNA, 25 bp, Homo sapiens
cggaggcggtgtctggagtcctctg

SEQ ID NO: 14917 - DNA, 25 bp, Homo sapiens
ggaggcggtgtctggagtcctctgt

SEQ ID NO: 14918 - DNA, 25 bp, Homo sapiens
gaggcggtgtctggagtcctctgtg

SEQ ID NO: 14919 - DNA, 25 bp, Homo sapiens
aggcggtgtctggagtcctctgtgg

SEQ ID NO: 14920 - DNA, 25 bp, Homo sapiens
ggcggtgtctggagtcctctgtgga

SEQ ID NO: 14921 - DNA, 25 bp, Homo sapiens
gcggtgtctggagtcctctgtggac

SEQ ID NO: 14922 - DNA, 25 bp, Homo sapiens
cggtgtctggagtcctctgtggacg

SEQ ID NO: 14923 - DNA, 25 bp, Homo sapiens
ggtgtctggagtcctctgtggacga

SEQ ID NO: 14924 - DNA, 25 bp, Homo sapiens
gtgtctggagtcctctgtggacgat

SEQ ID NO: 14925 - DNA, 25 bp, Homo sapiens
tgtctggagtcctctgtggacgatg

SEQ ID NO: 14926 - DNA, 25 bp, Homo sapiens
gtctggagtcctctgtggacgatgc

SEQ ID NO: 14927 - DNA, 25 bp, Homo sapiens
tctggagtcctctgtggacgatgcg

SEQ ID NO: 14928 - DNA, 25 bp, Homo sapiens
ctggagtcctctgtggacgatgcgg

SEQ ID NO: 14929 - DNA, 25 bp, Homo sapiens
tggagtcctctgtggacgatgcggg

SEQ ID NO: 14930 - DNA, 25 bp, Homo sapiens
ggagtcctctgtggacgatgcgggc

SEQ ID NO: 14931 - DNA, 25 bp, Homo sapiens
gagtcctctgtggacgatgcgggct

SEQ ID NO: 14932 - DNA, 25 bp, Homo sapiens
agtcctctgtggacgatgcgggctg

SEQ ID NO: 14933 - DNA, 25 bp, Homo sapiens
gtcctctgtggacgatgcgggctgt

SEQ ID NO: 14934 - DNA, 25 bp, Homo sapiens
tcctctgtggacgatgcgggctgtc

SEQ ID NO: 14935 - DNA, 25 bp, Homo sapiens
cctctgtggacgatgcgggctgtcc

SEQ ID NO: 14936 - DNA, 25 bp, Homo sapiens
ctctgtggacgatgcgggctgtcca

SEQ ID NO: 14937 - DNA, 25 bp, Homo sapiens
tctgtggacgatgcgggctgtccag

SEQ ID NO: 14938 - DNA, 25 bp, Homo sapiens
ctgtggacgatgcgggctgtccaga

SEQ ID NO: 14939 - DNA, 25 bp, Homo sapiens
tgtggacgatgcgggctgtccagac

SEQ ID NO: 14940 - DNA, 25 bp, Homo sapiens
gtggacgatgcgggctgtccagacc

SEQ ID NO: 14941 - DNA, 25 bp, Homo sapiens
tggacgatgcgggctgtccagacct

SEQ ID NO: 14942 - DNA, 25 bp, Homo sapiens
ggacgatgcgggctgtccagacctt

SEQ ID NO: 14943 - DNA, 25 bp, Homo sapiens
gacgatgcgggctgtccagaccttg

SEQ ID NO: 14944 - DNA, 25 bp, Homo sapiens
acgatgcgggctgtccagaccttgg

SEQ ID NO: 14945 - DNA, 25 bp, Homo sapiens
cgatgcgggctgtccagaccttgga

SEQ ID NO: 14946 - DNA, 25 bp, Homo sapiens
gatgcgggctgtccagaccttggaa

SEQ ID NO: 14947 - DNA, 25 bp, Homo sapiens
atgcgggctgtccagaccttggaaa

SEQ ID NO: 14948 - DNA, 25 bp, Homo sapiens
tgcgggctgtccagaccttggaaag

SEQ ID NO: 14949 - DNA, 25 bp, Homo sapiens
gcgggctgtccagaccttggaaagg

SEQ ID NO: 14950 - DNA, 25 bp, Homo sapiens
cgggctgtccagaccttggaaagga

SEQ ID NO: 14951 - DNA, 25 bp, Homo sapiens
gggctgtccagaccttggaaaggag

SEQ ID NO: 14952 - DNA, 25 bp, Homo sapiens
ggctgtccagaccttggaaaggagc

SEQ ID NO: 14953 - DNA, 25 bp, Homo sapiens
gctgtccagaccttggaaaggagcc

SEQ ID NO: 14954 - DNA, 25 bp, Homo sapiens
ctgtccagaccttggaaaggagccg

SEQ ID NO: 14955 - DNA, 25 bp, Homo sapiens
tgtccagaccttggaaaggagccgc

SEQ ID NO: 14956 - DNA, 25 bp, Homo sapiens
gtccagaccttggaaaggagccgct

SEQ ID NO: 14957 - DNA, 25 bp, Homo sapiens
tccagaccttggaaaggagccgctt

SEQ ID NO: 14958 - DNA, 25 bp, Homo sapiens
ccagaccttggaaaggagccgcttg

SEQ ID NO: 14959 - DNA, 25 bp, Homo sapiens
cagaccttggaaaggagccgcttgt

SEQ ID NO: 14960 - DNA, 25 bp, Homo sapiens
agaccttggaaaggagccgcttgtt

SEQ ID NO: 14961 - DNA, 25 bp, Homo sapiens
gaccttggaaaggagccgcttgttt

SEQ ID NO: 14962 - DNA, 25 bp, Homo sapiens
accttggaaaggagccgcttgtttt

SEQ ID NO: 14963 - DNA, 25 bp, Homo sapiens
ccttggaaaggagccgcttgttttc

SEQ ID NO: 14964 - DNA, 25 bp, Homo sapiens
cttggaaaggagccgcttgttttcc

SEQ ID NO: 14965 - DNA, 25 bp, Homo sapiens
ttggaaaggagccgcttgttttcca

SEQ ID NO: 14966 - DNA, 25 bp, Homo sapiens
tggaaaggagccgcttgttttccag

SEQ ID NO: 14967 - DNA, 25 bp, Homo sapiens
ggaaaggagccgcttgttttccaga

SEQ ID NO: 14968 - DNA, 25 bp, Homo sapiens
gaaaggagccgcttgttttccagaa

SEQ ID NO: 14969 - DNA, 25 bp, Homo sapiens
aaaggagccgcttgttttccagaac

SEQ ID NO: 14970 - DNA, 25 bp, Homo sapiens
aaggagccgcttgttttccagaacc

SEQ ID NO: 14971 - DNA, 25 bp, Homo sapiens
aggagccgcttgttttccagaaccg

SEQ ID NO: 14972 - DNA, 25 bp, Homo sapiens
ggagccgcttgttttccagaaccgc

SEQ ID NO: 14973 - DNA, 25 bp, Homo sapiens
gagccgcttgttttccagaaccgcc

SEQ ID NO: 14974 - DNA, 25 bp, Homo sapiens
agccgcttgttttccagaaccgcca

SEQ ID NO: 14975 - DNA, 25 bp, Homo sapiens
gccgcttgttttccagaaccgccag

SEQ ID NO: 14976 - DNA, 25 bp, Homo sapiens
ccgcttgttttccagaaccgccagt

SEQ ID NO: 14977 - DNA, 25 bp, Homo sapiens
cgcttgttttccagaaccgccagtt

SEQ ID NO: 14978 - DNA, 25 bp, Homo sapiens
gcttgttttccagaaccgccagttt

SEQ ID NO: 14979 - DNA, 25 bp, Homo sapiens
cttgttttccagaaccgccagtttg

SEQ ID NO: 14980 - DNA, 25 bp, Homo sapiens
ttgttttccagaaccgccagtttgc

SEQ ID NO: 14981 - DNA, 25 bp, Homo sapiens
tgttttccagaaccgccagtttgcc

SEQ ID NO: 14982 - DNA, 25 bp, Homo sapiens
gttttccagaaccgccagtttgccc

SEQ ID NO: 14983 - DNA, 25 bp, Homo sapiens
ttttccagaaccgccagtttgccca

SEQ ID NO: 14984 - DNA, 25 bp, Homo sapiens
tttccagaaccgccagtttgcccac

SEQ ID NO: 14985 - DNA, 25 bp, Homo sapiens
ttccagaaccgccagtttgcccacc

SEQ ID NO: 14986 - DNA, 25 bp, Homo sapiens
tccagaaccgccagtttgcccacct

SEQ ID NO: 14987 - DNA, 25 bp, Homo sapiens
ccagaaccgccagtttgcccacctg

SEQ ID NO: 14988 - DNA, 25 bp, Homo sapiens
cagaaccgccagtttgcccacctga

SEQ ID NO: 14989 - DNA, 25 bp, Homo sapiens
agaaccgccagtttgcccacctgat

SEQ ID NO: 14990 - DNA, 25 bp, Homo sapiens
gaaccgccagtttgcccacctgatg

SEQ ID NO: 14991 - DNA, 25 bp, Homo sapiens
aaccgccagtttgcccacctgatgg

SEQ ID NO: 14992 - DNA, 25 bp, Homo sapiens
accgccagtttgcccacctgatgga

SEQ ID NO: 14993 - DNA, 25 bp, Homo sapiens
ccgccagtttgcccacctgatggag

SEQ ID NO: 14994 - DNA, 25 bp, Homo sapiens
cgccagtttgcccacctgatggagg

SEQ ID NO: 14995 - DNA, 25 bp, Homo sapiens
gccagtttgcccacctgatggagga

SEQ ID NO: 14996 - DNA, 25 bp, Homo sapiens
ccagtttgcccacctgatggaggaa

SEQ ID NO: 14997 - DNA, 25 bp, Homo sapiens
cagtttgcccacctgatggaggaac

SEQ ID NO: 14998 - DNA, 25 bp, Homo sapiens
agtttgcccacctgatggaggaacc

SEQ ID NO: 14999 - DNA, 25 bp, Homo sapiens
gtttgcccacctgatggaggaacct

SEQ ID NO: 15000 - DNA, 25 bp, Homo sapiens
tttgcccacctgatggaggaacctc

SEQ ID NO: 15001 - DNA, 25 bp, Homo sapiens
ttgcccacctgatggaggaacctct

SEQ ID NO: 15002 - DNA, 25 bp, Homo sapiens
tgcccacctgatggaggaacctcta

SEQ ID NO: 15003 - DNA, 25 bp, Homo sapiens
gcccacctgatggaggaacctctag

SEQ ID NO: 15004 - DNA, 25 bp, Homo sapiens
cccacctgatggaggaacctctagg

SEQ ID NO: 15005 - DNA, 25 bp, Homo sapiens
ccacctgatggaggaacctctaggc

SEQ ID NO: 15006 - DNA, 25 bp, Homo sapiens
cacctgatggaggaacctctaggca

SEQ ID NO: 15007 - DNA, 25 bp, Homo sapiens
acctgatggaggaacctctaggcag

SEQ ID NO: 15008 - DNA, 25 bp, Homo sapiens
cctgatggaggaacctctaggcagt

SEQ ID NO: 15009 - DNA, 25 bp, Homo sapiens
ctgatggaggaacctctaggcagtg

SEQ ID NO: 15010 - DNA, 25 bp, Homo sapiens
tgatggaggaacctctaggcagtga

SEQ ID NO: 15011 - DNA, 25 bp, Homo sapiens
gatggaggaacctctaggcagtgac

SEQ ID NO: 15012 - DNA, 25 bp, Homo sapiens
atggaggaacctctaggcagtgacc

SEQ ID NO: 15013 - DNA, 25 bp, Homo sapiens
tggaggaacctctaggcagtgaccc

SEQ ID NO: 15014 - DNA, 25 bp, Homo sapiens
ggaggaacctctaggcagtgaccca

SEQ ID NO: 15015 - DNA, 25 bp, Homo sapiens
gaggaacctctaggcagtgacccat

SEQ ID NO: 15016 - DNA, 25 bp, Homo sapiens
aggaacctctaggcagtgacccatt

SEQ ID NO: 15017 - DNA, 25 bp, Homo sapiens
ggaacctctaggcagtgacccattc

SEQ ID NO: 15018 - DNA, 25 bp, Homo sapiens
gaacctctaggcagtgacccattca

SEQ ID NO: 15019 - DNA, 25 bp, Homo sapiens
aacctctaggcagtgacccattcag

SEQ ID NO: 15020 - DNA, 25 bp, Homo sapiens
acctctaggcagtgacccattcagc

SEQ ID NO: 15021 - DNA, 25 bp, Homo sapiens
cctctaggcagtgacccattcagct

SEQ ID NO: 15022 - DNA, 25 bp, Homo sapiens
ctctaggcagtgacccattcagctg

SEQ ID NO: 15023 - DNA, 25 bp, Homo sapiens
tctaggcagtgacccattcagctgg

SEQ ID NO: 15024 - DNA, 25 bp, Homo sapiens
ctaggcagtgacccattcagctgga

SEQ ID NO: 15025 - DNA, 25 bp, Homo sapiens
taggcagtgacccattcagctggaa

SEQ ID NO: 15026 - DNA, 25 bp, Homo sapiens
aggcagtgacccattcagctggaaa

SEQ ID NO: 15027 - DNA, 25 bp, Homo sapiens
ggcagtgacccattcagctggaaac

SEQ ID NO: 15028 - DNA, 25 bp, Homo sapiens
gcagtgacccattcagctggaaact

SEQ ID NO: 15029 - DNA, 25 bp, Homo sapiens
cagtgacccattcagctggaaactc

SEQ ID NO: 15030 - DNA, 25 bp, Homo sapiens
agtgacccattcagctggaaactcc

SEQ ID NO: 15031 - DNA, 25 bp, Homo sapiens
gtgacccattcagctggaaactccc

SEQ ID NO: 15032 - DNA, 25 bp, Homo sapiens
tgacccattcagctggaaactccca

SEQ ID NO: 15033 - DNA, 25 bp, Homo sapiens
gacccattcagctggaaactcccaa

SEQ ID NO: 15034 - DNA, 25 bp, Homo sapiens
acccattcagctggaaactcccaag

SEQ ID NO: 15035 - DNA, 25 bp, Homo sapiens
cccattcagctggaaactcccaagc

SEQ ID NO: 15036 - DNA, 25 bp, Homo sapiens
ccattcagctggaaactcccaagcc

SEQ ID NO: 15037 - DNA, 25 bp, Homo sapiens
cattcagctggaaactcccaagcct

SEQ ID NO: 15038 - DNA, 25 bp, Homo sapiens
attcagctggaaactcccaagcctc

SEQ ID NO: 15039 - DNA, 25 bp, Homo sapiens
ttcagctggaaactcccaagcctcg

SEQ ID NO: 15040 - DNA, 25 bp, Homo sapiens
tcagctggaaactcccaagcctcga

SEQ ID NO: 15041 - DNA, 25 bp, Homo sapiens
cagctggaaactcccaagcctcgac

SEQ ID NO: 15042 - DNA, 25 bp, Homo sapiens
agctggaaactcccaagcctcgact

SEQ ID NO: 15043 - DNA, 25 bp, Homo sapiens
gctggaaactcccaagcctcgacta

SEQ ID NO: 15044 - DNA, 25 bp, Homo sapiens
ctggaaactcccaagcctcgactac

SEQ ID NO: 15045 - DNA, 25 bp, Homo sapiens
tggaaactcccaagcctcgactacg

SEQ ID NO: 15046 - DNA, 25 bp, Homo sapiens
ggaaactcccaagcctcgactacga

SEQ ID NO: 15047 - DNA, 25 bp, Homo sapiens
gaaactcccaagcctcgactacgaa

SEQ ID NO: 15048 - DNA, 25 bp, Homo sapiens
aaactcccaagcctcgactacgaac

SEQ ID NO: 15049 - DNA, 25 bp, Homo sapiens
aactcccaagcctcgactacgaacg

SEQ ID NO: 15050 - DNA, 25 bp, Homo sapiens
actcccaagcctcgactacgaacgc

SEQ ID NO: 15051 - DNA, 25 bp, Homo sapiens
ctcccaagcctcgactacgaacgca

SEQ ID NO: 15052 - DNA, 25 bp, Homo sapiens
tcccaagcctcgactacgaacgcaa

SEQ ID NO: 15053 - DNA, 25 bp, Homo sapiens
cccaagcctcgactacgaacgcaag

SEQ ID NO: 15054 - DNA, 25 bp, Homo sapiens
ccaagcctcgactacgaacgcaaga

SEQ ID NO: 15055 - DNA, 25 bp, Homo sapiens
caagcctcgactacgaacgcaagac

SEQ ID NO: 15056 - DNA, 25 bp, Homo sapiens
aagcctcgactacgaacgcaagacc

SEQ ID NO: 15057 - DNA, 25 bp, Homo sapiens
agcctcgactacgaacgcaagacca

SEQ ID NO: 15058 - DNA, 25 bp, Homo sapiens
gcctcgactacgaacgcaagaccaa

SEQ ID NO: 15059 - DNA, 25 bp, Homo sapiens
cctcgactacgaacgcaagaccaaa

SEQ ID NO: 15060 - DNA, 25 bp, Homo sapiens
ctcgactacgaacgcaagaccaaag

SEQ ID NO: 15061 - DNA, 25 bp, Homo sapiens
tcgactacgaacgcaagaccaaagt

SEQ ID NO: 15062 - DNA, 25 bp, Homo sapiens
cgactacgaacgcaagaccaaagtg

SEQ ID NO: 15063 - DNA, 25 bp, Homo sapiens
gactacgaacgcaagaccaaagtgg

SEQ ID NO: 15064 - DNA, 25 bp, Homo sapiens
actacgaacgcaagaccaaagtgga

SEQ ID NO: 15065 - DNA, 25 bp, Homo sapiens
ctacgaacgcaagaccaaagtggac

SEQ ID NO: 15066 - DNA, 25 bp, Homo sapiens
tacgaacgcaagaccaaagtggact

SEQ ID NO: 15067 - DNA, 25 bp, Homo sapiens
acgaacgcaagaccaaagtggactt

SEQ ID NO: 15068 - DNA, 25 bp, Homo sapiens
cgaacgcaagaccaaagtggacttc

SEQ ID NO: 15069 - DNA, 25 bp, Homo sapiens
gaacgcaagaccaaagtggacttcg

SEQ ID NO: 15070 - DNA, 25 bp, Homo sapiens
aacgcaagaccaaagtggacttcga

SEQ ID NO: 15071 - DNA, 25 bp, Homo sapiens
acgcaagaccaaagtggacttcgat

SEQ ID NO: 15072 - DNA, 25 bp, Homo sapiens
cgcaagaccaaagtggacttcgatg

SEQ ID NO: 15073 - DNA, 25 bp, Homo sapiens
gcaagaccaaagtggacttcgatga

SEQ ID NO: 15074 - DNA, 25 bp, Homo sapiens
caagaccaaagtggacttcgatgac

SEQ ID NO: 15075 - DNA, 25 bp, Homo sapiens
aagaccaaagtggacttcgatgact

SEQ ID NO: 15076 - DNA, 25 bp, Homo sapiens
agaccaaagtggacttcgatgactt

SEQ ID NO: 15077 - DNA, 25 bp, Homo sapiens
gaccaaagtggacttcgatgacttc

SEQ ID NO: 15078 - DNA, 25 bp, Homo sapiens
accaaagtggacttcgatgacttcc

SEQ ID NO: 15079 - DNA, 25 bp, Homo sapiens
ccaaagtggacttcgatgacttcct

SEQ ID NO: 15080 - DNA, 25 bp, Homo sapiens
caaagtggacttcgatgacttcctc

SEQ ID NO: 15081 - DNA, 25 bp, Homo sapiens
aaagtggacttcgatgacttcctcc

SEQ ID NO: 15082 - DNA, 25 bp, Homo sapiens
aagtggacttcgatgacttcctccc

SEQ ID NO: 15083 - DNA, 25 bp, Homo sapiens
agtggacttcgatgacttcctccca

SEQ ID NO: 15084 - DNA, 25 bp, Homo sapiens
gtggacttcgatgacttcctcccag

SEQ ID NO: 15085 - DNA, 25 bp, Homo sapiens
tggacttcgatgacttcctcccagc

SEQ ID NO: 15086 - DNA, 25 bp, Homo sapiens
ggacttcgatgacttcctcccagct

SEQ ID NO: 15087 - DNA, 25 bp, Homo sapiens
gacttcgatgacttcctcccagcta

SEQ ID NO: 15088 - DNA, 25 bp, Homo sapiens
acttcgatgacttcctcccagctat

SEQ ID NO: 15089 - DNA, 25 bp, Homo sapiens
cttcgatgacttcctcccagctatc

SEQ ID NO: 15090 - DNA, 25 bp, Homo sapiens
ttcgatgacttcctcccagctatcc

SEQ ID NO: 15091 - DNA, 25 bp, Homo sapiens
tcgatgacttcctcccagctatccg

SEQ ID NO: 15092 - DNA, 25 bp, Homo sapiens
cgatgacttcctcccagctatccgg

SEQ ID NO: 15093 - DNA, 25 bp, Homo sapiens
gatgacttcctcccagctatccgga

SEQ ID NO: 15094 - DNA, 25 bp, Homo sapiens
atgacttcctcccagctatccggaa

SEQ ID NO: 15095 - DNA, 25 bp, Homo sapiens
tgacttcctcccagctatccggaag

SEQ ID NO: 15096 - DNA, 25 bp, Homo sapiens
gacttcctcccagctatccggaagc

SEQ ID NO: 15097 - DNA, 25 bp, Homo sapiens
acttcctcccagctatccggaagcc

SEQ ID NO: 15098 - DNA, 25 bp, Homo sapiens
cttcctcccagctatccggaagccc

SEQ ID NO: 15099 - DNA, 25 bp, Homo sapiens
ttcctcccagctatccggaagcccc

SEQ ID NO: 15100 - DNA, 25 bp, Homo sapiens
tcctcccagctatccggaagcccca

SEQ ID NO: 15101 - DNA, 25 bp, Homo sapiens
cctcccagctatccggaagccccag

SEQ ID NO: 15102 - DNA, 25 bp, Homo sapiens
ctcccagctatccggaagccccaga

SEQ ID NO: 15103 - DNA, 25 bp, Homo sapiens
tcccagctatccggaagccccagac

SEQ ID NO: 15104 - DNA, 25 bp, Homo sapiens
cccagctatccggaagccccagaca

SEQ ID NO: 15105 - DNA, 25 bp, Homo sapiens
ccagctatccggaagccccagacac

SEQ ID NO: 15106 - DNA, 25 bp, Homo sapiens
cagctatccggaagccccagacacc

SEQ ID NO: 15107 - DNA, 25 bp, Homo sapiens
agctatccggaagccccagacacct

SEQ ID NO: 15108 - DNA, 25 bp, Homo sapiens
gctatccggaagccccagacaccta

SEQ ID NO: 15109 - DNA, 25 bp, Homo sapiens
ctatccggaagccccagacacctac

SEQ ID NO: 15110 - DNA, 25 bp, Homo sapiens
tatccggaagccccagacacctacc

SEQ ID NO: 15111 - DNA, 25 bp, Homo sapiens
atccggaagccccagacacctacct

SEQ ID NO: 15112 - DNA, 25 bp, Homo sapiens
tccggaagccccagacacctacctc

SEQ ID NO: 15113 - DNA, 25 bp, Homo sapiens
ccggaagccccagacacctacctcc

SEQ ID NO: 15114 - DNA, 25 bp, Homo sapiens
cggaagccccagacacctacctcct

SEQ ID NO: 15115 - DNA, 25 bp, Homo sapiens
ggaagccccagacacctacctcctt

SEQ ID NO: 15116 - DNA, 25 bp, Homo sapiens
gaagccccagacacctacctccttg

SEQ ID NO: 15117 - DNA, 25 bp, Homo sapiens
aagccccagacacctacctccttgg

SEQ ID NO: 15118 - DNA, 25 bp, Homo sapiens
agccccagacacctacctccttggc

SEQ ID NO: 15119 - DNA, 25 bp, Homo sapiens
gccccagacacctacctccttggct

SEQ ID NO: 15120 - DNA, 25 bp, Homo sapiens
ccccagacacctacctccttggctg

SEQ ID NO: 15121 - DNA, 25 bp, Homo sapiens
cccagacacctacctccttggctgg

SEQ ID NO: 15122 - DNA, 25 bp, Homo sapiens
ccagacacctacctccttggctgga

SEQ ID NO: 15123 - DNA, 25 bp, Homo sapiens
cagacacctacctccttggctggat

SEQ ID NO: 15124 - DNA, 25 bp, Homo sapiens
agacacctacctccttggctggatc

SEQ ID NO: 15125 - DNA, 25 bp, Homo sapiens
gacacctacctccttggctggatca

SEQ ID NO: 15126 - DNA, 25 bp, Homo sapiens
acacctacctccttggctggatcag

SEQ ID NO: 15127 - DNA, 25 bp, Homo sapiens
cacctacctccttggctggatcagc

SEQ ID NO: 15128 - DNA, 25 bp, Homo sapiens
acctacctccttggctggatcagcc

SEQ ID NO: 15129 - DNA, 25 bp, Homo sapiens
cctacctccttggctggatcagcca

SEQ ID NO: 15130 - DNA, 25 bp, Homo sapiens
ctacctccttggctggatcagccaa

SEQ ID NO: 15131 - DNA, 25 bp, Homo sapiens
tacctccttggctggatcagccaaa

SEQ ID NO: 15132 - DNA, 25 bp, Homo sapiens
acctccttggctggatcagccaaag

SEQ ID NO: 15133 - DNA, 25 bp, Homo sapiens
cctccttggctggatcagccaaagg

SEQ ID NO: 15134 - DNA, 25 bp, Homo sapiens
ctccttggctggatcagccaaaggt

SEQ ID NO: 15135 - DNA, 25 bp, Homo sapiens
tccttggctggatcagccaaaggtg

SEQ ID NO: 15136 - DNA, 25 bp, Homo sapiens
ccttggctggatcagccaaaggtgg

SEQ ID NO: 15137 - DNA, 25 bp, Homo sapiens
cttggctggatcagccaaaggtggg

SEQ ID NO: 15138 - DNA, 25 bp, Homo sapiens
ttggctggatcagccaaaggtgggc

SEQ ID NO: 15139 - DNA, 25 bp, Homo sapiens
tggctggatcagccaaaggtgggca

SEQ ID NO: 15140 - DNA, 25 bp, Homo sapiens
ggctggatcagccaaaggtgggcaa

SEQ ID NO: 15141 - DNA, 25 bp, Homo sapiens
gctggatcagccaaaggtgggcaag

SEQ ID NO: 15142 - DNA, 25 bp, Homo sapiens
ctggatcagccaaaggtgggcaaga

SEQ ID NO: 15143 - DNA, 25 bp, Homo sapiens
tggatcagccaaaggtgggcaagac

SEQ ID NO: 15144 - DNA, 25 bp, Homo sapiens
ggatcagccaaaggtgggcaagacg

SEQ ID NO: 15145 - DNA, 25 bp, Homo sapiens
gatcagccaaaggtgggcaagacgg

SEQ ID NO: 15146 - DNA, 25 bp, Homo sapiens
atcagccaaaggtgggcaagacggt

SEQ ID NO: 15147 - DNA, 25 bp, Homo sapiens
tcagccaaaggtgggcaagacggtt

SEQ ID NO: 15148 - DNA, 25 bp, Homo sapiens
cagccaaaggtgggcaagacggttc

SEQ ID NO: 15149 - DNA, 25 bp, Homo sapiens
agccaaaggtgggcaagacggttca

SEQ ID NO: 15150 - DNA, 25 bp, Homo sapiens
gccaaaggtgggcaagacggttcac

SEQ ID NO: 15151 - DNA, 25 bp, Homo sapiens
ccaaaggtgggcaagacggttcaca

SEQ ID NO: 15152 - DNA, 25 bp, Homo sapiens
caaaggtgggcaagacggttcacag

SEQ ID NO: 15153 - DNA, 25 bp, Homo sapiens
aaaggtgggcaagacggttcacagc

SEQ ID NO: 15154 - DNA, 25 bp, Homo sapiens
aaggtgggcaagacggttcacagcg

SEQ ID NO: 15155 - DNA, 25 bp, Homo sapiens
aggtgggcaagacggttcacagcgt

SEQ ID NO: 15156 - DNA, 25 bp, Homo sapiens
ggtgggcaagacggttcacagcgtt

SEQ ID NO: 15157 - DNA, 25 bp, Homo sapiens
gtgggcaagacggttcacagcgttc

SEQ ID NO: 15158 - DNA, 25 bp, Homo sapiens
tgggcaagacggttcacagcgttca

SEQ ID NO: 15159 - DNA, 25 bp, Homo sapiens
gggcaagacggttcacagcgttcaa

SEQ ID NO: 15160 - DNA, 25 bp, Homo sapiens
ggcaagacggttcacagcgttcaag

SEQ ID NO: 15161 - DNA, 25 bp, Homo sapiens
gcaagacggttcacagcgttcaagc

SEQ ID NO: 15162 - DNA, 25 bp, Homo sapiens
caagacggttcacagcgttcaagca

SEQ ID NO: 15163 - DNA, 25 bp, Homo sapiens
aagacggttcacagcgttcaagcat

SEQ ID NO: 15164 - DNA, 25 bp, Homo sapiens
agacggttcacagcgttcaagcatc

SEQ ID NO: 15165 - DNA, 25 bp, Homo sapiens
gacggttcacagcgttcaagcatcc

SEQ ID NO: 15166 - DNA, 25 bp, Homo sapiens
acggttcacagcgttcaagcatcca

SEQ ID NO: 15167 - DNA, 25 bp, Homo sapiens
cggttcacagcgttcaagcatccac

SEQ ID NO: 15168 - DNA, 25 bp, Homo sapiens
ggttcacagcgttcaagcatccact

SEQ ID NO: 15169 - DNA, 25 bp, Homo sapiens
gttcacagcgttcaagcatccactt

SEQ ID NO: 15170 - DNA, 25 bp, Homo sapiens
ttcacagcgttcaagcatccacttt

SEQ ID NO: 15171 - DNA, 25 bp, Homo sapiens
tcacagcgttcaagcatccactttg

SEQ ID NO: 15172 - DNA, 25 bp, Homo sapiens
cacagcgttcaagcatccactttga

SEQ ID NO: 15173 - DNA, 25 bp, Homo sapiens
acagcgttcaagcatccactttgaa

SEQ ID NO: 15174 - DNA, 25 bp, Homo sapiens
cagcgttcaagcatccactttgaaa

SEQ ID NO: 15175 - DNA, 25 bp, Homo sapiens
agcgttcaagcatccactttgaaac

SEQ ID NO: 15176 - DNA, 25 bp, Homo sapiens
gcgttcaagcatccactttgaaacg

SEQ ID NO: 15177 - DNA, 25 bp, Homo sapiens
cgttcaagcatccactttgaaacgg

SEQ ID NO: 15178 - DNA, 25 bp, Homo sapiens
gttcaagcatccactttgaaacgga

SEQ ID NO: 15179 - DNA, 25 bp, Homo sapiens
ttcaagcatccactttgaaacggaa

SEQ ID NO: 15180 - DNA, 25 bp, Homo sapiens
tcaagcatccactttgaaacggaag

SEQ ID NO: 15181 - DNA, 25 bp, Homo sapiens
caagcatccactttgaaacggaaga

SEQ ID NO: 15182 - DNA, 25 bp, Homo sapiens
aagcatccactttgaaacggaagag

SEQ ID NO: 15183 - DNA, 25 bp, Homo sapiens
agcatccactttgaaacggaagagg

SEQ ID NO: 15184 - DNA, 25 bp, Homo sapiens
gcatccactttgaaacggaagaggc

SEQ ID NO: 15185 - DNA, 25 bp, Homo sapiens
catccactttgaaacggaagaggct

SEQ ID NO: 15186 - DNA, 25 bp, Homo sapiens
atccactttgaaacggaagaggcta

SEQ ID NO: 15187 - DNA, 25 bp, Homo sapiens
tccactttgaaacggaagaggctaa

SEQ ID NO: 15188 - DNA, 25 bp, Homo sapiens
ccactttgaaacggaagaggctaac

SEQ ID NO: 15189 - DNA, 25 bp, Homo sapiens
cactttgaaacggaagaggctaacc

SEQ ID NO: 15190 - DNA, 25 bp, Homo sapiens
actttgaaacggaagaggctaaccg

SEQ ID NO: 15191 - DNA, 25 bp, Homo sapiens
ctttgaaacggaagaggctaaccgt

SEQ ID NO: 15192 - DNA, 25 bp, Homo sapiens
tttgaaacggaagaggctaaccgtt

SEQ ID NO: 15193 - DNA, 25 bp, Homo sapiens
ttgaaacggaagaggctaaccgttc

SEQ ID NO: 15194 - DNA, 25 bp, Homo sapiens
tgaaacggaagaggctaaccgttcc

SEQ ID NO: 15195 - DNA, 25 bp, Homo sapiens
gaaacggaagaggctaaccgttcct

SEQ ID NO: 15196 - DNA, 25 bp, Homo sapiens
aaacggaagaggctaaccgttcctt

SEQ ID NO: 15197 - DNA, 25 bp, Homo sapiens
aacggaagaggctaaccgttccttt

SEQ ID NO: 15198 - DNA, 25 bp, Homo sapiens
acggaagaggctaaccgttcctttc

SEQ ID NO: 15199 - DNA, 25 bp, Homo sapiens
cggaagaggctaaccgttcctttct

SEQ ID NO: 15200 - DNA, 25 bp, Homo sapiens
ggaagaggctaaccgttcctttctc

SEQ ID NO: 15201 - DNA, 25 bp, Homo sapiens
gaagaggctaaccgttcctttctct

SEQ ID NO: 15202 - DNA, 25 bp, Homo sapiens
aagaggctaaccgttcctttctctc

SEQ ID NO: 15203 - DNA, 25 bp, Homo sapiens
agaggctaaccgttcctttctctcg

SEQ ID NO: 15204 - DNA, 25 bp, Homo sapiens
gaggctaaccgttcctttctctcgg

SEQ ID NO: 15205 - DNA, 25 bp, Homo sapiens
aggctaaccgttcctttctctcggg

SEQ ID NO: 15206 - DNA, 25 bp, Homo sapiens
ggctaaccgttcctttctctcgggg

SEQ ID NO: 15207 - DNA, 25 bp, Homo sapiens
gctaaccgttcctttctctcgggga

SEQ ID NO: 15208 - DNA, 25 bp, Homo sapiens
ctaaccgttcctttctctcggggat

SEQ ID NO: 15209 - DNA, 25 bp, Homo sapiens
taaccgttcctttctctcggggatc

SEQ ID NO: 15210 - DNA, 25 bp, Homo sapiens
aaccgttcctttctctcggggatca

SEQ ID NO: 15211 - DNA, 25 bp, Homo sapiens
accgttcctttctctcggggatcaa

SEQ ID NO: 15212 - DNA, 25 bp, Homo sapiens
ccgttcctttctctcggggatcaag

SEQ ID NO: 15213 - DNA, 25 bp, Homo sapiens
cgttcctttctctcggggatcaaga

SEQ ID NO: 15214 - DNA, 25 bp, Homo sapiens
gttcctttctctcggggatcaagac

SEQ ID NO: 15215 - DNA, 25 bp, Homo sapiens
ttcctttctctcggggatcaagacc

SEQ ID NO: 15216 - DNA, 25 bp, Homo sapiens
tcctttctctcggggatcaagacca

SEQ ID NO: 15217 - DNA, 25 bp, Homo sapiens
cctttctctcggggatcaagaccat

SEQ ID NO: 15218 - DNA, 25 bp, Homo sapiens
ctttctctcggggatcaagaccatt

SEQ ID NO: 15219 - DNA, 25 bp, Homo sapiens
tttctctcggggatcaagaccattt

SEQ ID NO: 15220 - DNA, 25 bp, Homo sapiens
ttctctcggggatcaagaccatttt

SEQ ID NO: 15221 - DNA, 25 bp, Homo sapiens
tctctcggggatcaagaccattttg

SEQ ID NO: 15222 - DNA, 25 bp, Homo sapiens
ctctcggggatcaagaccattttga

SEQ ID NO: 15223 - DNA, 25 bp, Homo sapiens
tctcggggatcaagaccattttgaa

SEQ ID NO: 15224 - DNA, 25 bp, Homo sapiens
ctcggggatcaagaccattttgaag

SEQ ID NO: 15225 - DNA, 25 bp, Homo sapiens
tcggggatcaagaccattttgaaga

SEQ ID NO: 15226 - DNA, 25 bp, Homo sapiens
cggggatcaagaccattttgaagaa

SEQ ID NO: 15227 - DNA, 25 bp, Homo sapiens
ggggatcaagaccattttgaagaag

SEQ ID NO: 15228 - DNA, 25 bp, Homo sapiens
gggatcaagaccattttgaagaaga

SEQ ID NO: 15229 - DNA, 25 bp, Homo sapiens
ggatcaagaccattttgaagaagag

SEQ ID NO: 15230 - DNA, 25 bp, Homo sapiens
gatcaagaccattttgaagaagagc

SEQ ID NO: 15231 - DNA, 25 bp, Homo sapiens
atcaagaccattttgaagaagagcc

SEQ ID NO: 15232 - DNA, 25 bp, Homo sapiens
tcaagaccattttgaagaagagccc

SEQ ID NO: 15233 - DNA, 25 bp, Homo sapiens
caagaccattttgaagaagagcccg

SEQ ID NO: 15234 - DNA, 25 bp, Homo sapiens
aagaccattttgaagaagagcccgg

SEQ ID NO: 15235 - DNA, 25 bp, Homo sapiens
agaccattttgaagaagagcccgga

SEQ ID NO: 15236 - DNA, 25 bp, Homo sapiens
gaccattttgaagaagagcccggag

SEQ ID NO: 15237 - DNA, 25 bp, Homo sapiens
accattttgaagaagagcccggagc

SEQ ID NO: 15238 - DNA, 25 bp, Homo sapiens
ccattttgaagaagagcccggagcc

SEQ ID NO: 15239 - DNA, 25 bp, Homo sapiens
cattttgaagaagagcccggagccc

SEQ ID NO: 15240 - DNA, 25 bp, Homo sapiens
attttgaagaagagcccggagccca

SEQ ID NO: 15241 - DNA, 25 bp, Homo sapiens
ttttgaagaagagcccggagcccaa

SEQ ID NO: 15242 - DNA, 25 bp, Homo sapiens
tttgaagaagagcccggagcccaag

SEQ ID NO: 15243 - DNA, 25 bp, Homo sapiens
ttgaagaagagcccggagcccaagg

SEQ ID NO: 15244 - DNA, 25 bp, Homo sapiens
tgaagaagagcccggagcccaagga

SEQ ID NO: 15245 - DNA, 25 bp, Homo sapiens
gaagaagagcccggagcccaaggag

SEQ ID NO: 15246 - DNA, 25 bp, Homo sapiens
aagaagagcccggagcccaaggagg

SEQ ID NO: 15247 - DNA, 25 bp, Homo sapiens
agaagagcccggagcccaaggagga

SEQ ID NO: 15248 - DNA, 25 bp, Homo sapiens
gaagagcccggagcccaaggaggat

SEQ ID NO: 15249 - DNA, 25 bp, Homo sapiens
aagagcccggagcccaaggaggatc

SEQ ID NO: 15250 - DNA, 25 bp, Homo sapiens
agagcccggagcccaaggaggatcc

SEQ ID NO: 15251 - DNA, 25 bp, Homo sapiens
gagcccggagcccaaggaggatccc

SEQ ID NO: 15252 - DNA, 25 bp, Homo sapiens
agcccggagcccaaggaggatcccg

SEQ ID NO: 15253 - DNA, 25 bp, Homo sapiens
gcccggagcccaaggaggatcccgc

SEQ ID NO: 15254 - DNA, 25 bp, Homo sapiens
cccggagcccaaggaggatcccgct

SEQ ID NO: 15255 - DNA, 25 bp, Homo sapiens
ccggagcccaaggaggatcccgctc

SEQ ID NO: 15256 - DNA, 25 bp, Homo sapiens
cggagcccaaggaggatcccgctca

SEQ ID NO: 15257 - DNA, 25 bp, Homo sapiens
ggagcccaaggaggatcccgctcac

SEQ ID NO: 15258 - DNA, 25 bp, Homo sapiens
gagcccaaggaggatcccgctcacc

SEQ ID NO: 15259 - DNA, 25 bp, Homo sapiens
agcccaaggaggatcccgctcacct

SEQ ID NO: 15260 - DNA, 25 bp, Homo sapiens
gcccaaggaggatcccgctcacctg

SEQ ID NO: 15261 - DNA, 25 bp, Homo sapiens
cccaaggaggatcccgctcacctgt

SEQ ID NO: 15262 - DNA, 25 bp, Homo sapiens
ccaaggaggatcccgctcacctgtc

SEQ ID NO: 15263 - DNA, 25 bp, Homo sapiens
caaggaggatcccgctcacctgtct

SEQ ID NO: 15264 - DNA, 25 bp, Homo sapiens
aaggaggatcccgctcacctgtctg

SEQ ID NO: 15265 - DNA, 25 bp, Homo sapiens
aggaggatcccgctcacctgtctga

SEQ ID NO: 15266 - DNA, 25 bp, Homo sapiens
ggaggatcccgctcacctgtctgac

SEQ ID NO: 15267 - DNA, 25 bp, Homo sapiens
gaggatcccgctcacctgtctgact

SEQ ID NO: 15268 - DNA, 25 bp, Homo sapiens
aggatcccgctcacctgtctgactc

SEQ ID NO: 15269 - DNA, 25 bp, Homo sapiens
ggatcccgctcacctgtctgactcg

SEQ ID NO: 15270 - DNA, 25 bp, Homo sapiens
gatcccgctcacctgtctgactcgt

SEQ ID NO: 15271 - DNA, 25 bp, Homo sapiens
atcccgctcacctgtctgactcgtc

SEQ ID NO: 15272 - DNA, 25 bp, Homo sapiens
tcccgctcacctgtctgactcgtcc

SEQ ID NO: 15273 - DNA, 25 bp, Homo sapiens
cccgctcacctgtctgactcgtcct

SEQ ID NO: 15274 - DNA, 25 bp, Homo sapiens
ccgctcacctgtctgactcgtcctc

SEQ ID NO: 15275 - DNA, 25 bp, Homo sapiens
cgctcacctgtctgactcgtcctca

SEQ ID NO: 15276 - DNA, 25 bp, Homo sapiens
gctcacctgtctgactcgtcctcat

SEQ ID NO: 15277 - DNA, 25 bp, Homo sapiens
ctcacctgtctgactcgtcctcatc

SEQ ID NO: 15278 - DNA, 25 bp, Homo sapiens
tcacctgtctgactcgtcctcatcc

SEQ ID NO: 15279 - DNA, 25 bp, Homo sapiens
cacctgtctgactcgtcctcatcct

SEQ ID NO: 15280 - DNA, 25 bp, Homo sapiens
acctgtctgactcgtcctcatcctc

SEQ ID NO: 15281 - DNA, 25 bp, Homo sapiens
cctgtctgactcgtcctcatcctcc

SEQ ID NO: 15282 - DNA, 25 bp, Homo sapiens
ctgtctgactcgtcctcatcctccg

SEQ ID NO: 15283 - DNA, 25 bp, Homo sapiens
tgtctgactcgtcctcatcctccgg

SEQ ID NO: 15284 - DNA, 25 bp, Homo sapiens
gtctgactcgtcctcatcctccggc

SEQ ID NO: 15285 - DNA, 25 bp, Homo sapiens
tctgactcgtcctcatcctccggct

SEQ ID NO: 15286 - DNA, 25 bp, Homo sapiens
ctgactcgtcctcatcctccggctc

SEQ ID NO: 15287 - DNA, 25 bp, Homo sapiens
tgactcgtcctcatcctccggctcc

SEQ ID NO: 15288 - DNA, 25 bp, Homo sapiens
gactcgtcctcatcctccggctcca

SEQ ID NO: 15289 - DNA, 25 bp, Homo sapiens
actcgtcctcatcctccggctccat

SEQ ID NO: 15290 - DNA, 25 bp, Homo sapiens
ctcgtcctcatcctccggctccatc

SEQ ID NO: 15291 - DNA, 25 bp, Homo sapiens
tcgtcctcatcctccggctccatcg

SEQ ID NO: 15292 - DNA, 25 bp, Homo sapiens
cgtcctcatcctccggctccatcgt

SEQ ID NO: 15293 - DNA, 25 bp, Homo sapiens
gtcctcatcctccggctccatcgtg

SEQ ID NO: 15294 - DNA, 25 bp, Homo sapiens
tcctcatcctccggctccatcgtgt

SEQ ID NO: 15295 - DNA, 25 bp, Homo sapiens
cctcatcctccggctccatcgtgtc

SEQ ID NO: 15296 - DNA, 25 bp, Homo sapiens
ctcatcctccggctccatcgtgtcc

SEQ ID NO: 15297 - DNA, 25 bp, Homo sapiens
tcatcctccggctccatcgtgtcct

SEQ ID NO: 15298 - DNA, 25 bp, Homo sapiens
catcctccggctccatcgtgtcctt

SEQ ID NO: 15299 - DNA, 25 bp, Homo sapiens
atcctccggctccatcgtgtccttc

SEQ ID NO: 15300 - DNA, 25 bp, Homo sapiens
tcctccggctccatcgtgtccttca

SEQ ID NO: 15301 - DNA, 25 bp, Homo sapiens
cctccggctccatcgtgtccttcaa

SEQ ID NO: 15302 - DNA, 25 bp, Homo sapiens
ctccggctccatcgtgtccttcaaa

SEQ ID NO: 15303 - DNA, 25 bp, Homo sapiens
tccggctccatcgtgtccttcaaaa

SEQ ID NO: 15304 - DNA, 25 bp, Homo sapiens
ccggctccatcgtgtccttcaaaag

SEQ ID NO: 15305 - DNA, 25 bp, Homo sapiens
cggctccatcgtgtccttcaaaagt

SEQ ID NO: 15306 - DNA, 25 bp, Homo sapiens
ggctccatcgtgtccttcaaaagtg

SEQ ID NO: 15307 - DNA, 25 bp, Homo sapiens
gctccatcgtgtccttcaaaagtgc

SEQ ID NO: 15308 - DNA, 25 bp, Homo sapiens
ctccatcgtgtccttcaaaagtgct

SEQ ID NO: 15309 - DNA, 25 bp, Homo sapiens
tccatcgtgtccttcaaaagtgctg

SEQ ID NO: 15310 - DNA, 25 bp, Homo sapiens
ccatcgtgtccttcaaaagtgctga

SEQ ID NO: 15311 - DNA, 25 bp, Homo sapiens
catcgtgtccttcaaaagtgctgac

SEQ ID NO: 15312 - DNA, 25 bp, Homo sapiens
atcgtgtccttcaaaagtgctgaca

SEQ ID NO: 15313 - DNA, 25 bp, Homo sapiens
tcgtgtccttcaaaagtgctgacag

SEQ ID NO: 15314 - DNA, 25 bp, Homo sapiens
cgtgtccttcaaaagtgctgacagc

SEQ ID NO: 15315 - DNA, 25 bp, Homo sapiens
gtgtccttcaaaagtgctgacagca

SEQ ID NO: 15316 - DNA, 25 bp, Homo sapiens
tgtccttcaaaagtgctgacagcat

SEQ ID NO: 15317 - DNA, 25 bp, Homo sapiens
gtccttcaaaagtgctgacagcatc

SEQ ID NO: 15318 - DNA, 25 bp, Homo sapiens
tccttcaaaagtgctgacagcatca

SEQ ID NO: 15319 - DNA, 25 bp, Homo sapiens
ccttcaaaagtgctgacagcatcaa

SEQ ID NO: 15320 - DNA, 25 bp, Homo sapiens
cttcaaaagtgctgacagcatcaaa

SEQ ID NO: 15321 - DNA, 25 bp, Homo sapiens
ttcaaaagtgctgacagcatcaaaa

SEQ ID NO: 15322 - DNA, 25 bp, Homo sapiens
tcaaaagtgctgacagcatcaaaag

SEQ ID NO: 15323 - DNA, 25 bp, Homo sapiens
caaaagtgctgacagcatcaaaagt

SEQ ID NO: 15324 - DNA, 25 bp, Homo sapiens
aaaagtgctgacagcatcaaaagtc

SEQ ID NO: 15325 - DNA, 25 bp, Homo sapiens
aaagtgctgacagcatcaaaagtcg

SEQ ID NO: 15326 - DNA, 25 bp, Homo sapiens
aagtgctgacagcatcaaaagtcga

SEQ ID NO: 15327 - DNA, 25 bp, Homo sapiens
agtgctgacagcatcaaaagtcgac

SEQ ID NO: 15328 - DNA, 25 bp, Homo sapiens
gtgctgacagcatcaaaagtcgacc

SEQ ID NO: 15329 - DNA, 25 bp, Homo sapiens
tgctgacagcatcaaaagtcgacca

SEQ ID NO: 15330 - DNA, 25 bp, Homo sapiens
gctgacagcatcaaaagtcgaccag

SEQ ID NO: 15331 - DNA, 25 bp, Homo sapiens
ctgacagcatcaaaagtcgaccagg

SEQ ID NO: 15332 - DNA, 25 bp, Homo sapiens
tgacagcatcaaaagtcgaccagga

SEQ ID NO: 15333 - DNA, 25 bp, Homo sapiens
gacagcatcaaaagtcgaccaggaa

SEQ ID NO: 15334 - DNA, 25 bp, Homo sapiens
acagcatcaaaagtcgaccaggaat

SEQ ID NO: 15335 - DNA, 25 bp, Homo sapiens
cagcatcaaaagtcgaccaggaatc

SEQ ID NO: 15336 - DNA, 25 bp, Homo sapiens
agcatcaaaagtcgaccaggaatcc

SEQ ID NO: 15337 - DNA, 25 bp, Homo sapiens
gcatcaaaagtcgaccaggaatccc

SEQ ID NO: 15338 - DNA, 25 bp, Homo sapiens
catcaaaagtcgaccaggaatccca

SEQ ID NO: 15339 - DNA, 25 bp, Homo sapiens
atcaaaagtcgaccaggaatcccac

SEQ ID NO: 15340 - DNA, 25 bp, Homo sapiens
tcaaaagtcgaccaggaatcccacg

SEQ ID NO: 15341 - DNA, 25 bp, Homo sapiens
caaaagtcgaccaggaatcccacga

SEQ ID NO: 15342 - DNA, 25 bp, Homo sapiens
aaaagtcgaccaggaatcccacgac

SEQ ID NO: 15343 - DNA, 25 bp, Homo sapiens
aaagtcgaccaggaatcccacgact

SEQ ID NO: 15344 - DNA, 25 bp, Homo sapiens
aagtcgaccaggaatcccacgactt

SEQ ID NO: 15345 - DNA, 25 bp, Homo sapiens
agtcgaccaggaatcccacgacttg

SEQ ID NO: 15346 - DNA, 25 bp, Homo sapiens
gtcgaccaggaatcccacgacttgc

SEQ ID NO: 15347 - DNA, 25 bp, Homo sapiens
tcgaccaggaatcccacgacttgcg

SEQ ID NO: 15348 - DNA, 25 bp, Homo sapiens
cgaccaggaatcccacgacttgcgg

SEQ ID NO: 15349 - DNA, 25 bp, Homo sapiens
gaccaggaatcccacgacttgcggg

SEQ ID NO: 15350 - DNA, 25 bp, Homo sapiens
accaggaatcccacgacttgcgggt

SEQ ID NO: 15351 - DNA, 25 bp, Homo sapiens
ccaggaatcccacgacttgcgggtg

SEQ ID NO: 15352 - DNA, 25 bp, Homo sapiens
caggaatcccacgacttgcgggtga

SEQ ID NO: 15353 - DNA, 25 bp, Homo sapiens
aggaatcccacgacttgcgggtgac

SEQ ID NO: 15354 - DNA, 25 bp, Homo sapiens
ggaatcccacgacttgcgggtgacg

SEQ ID NO: 15355 - DNA, 25 bp, Homo sapiens
gaatcccacgacttgcgggtgacgg

SEQ ID NO: 15356 - DNA, 25 bp, Homo sapiens
aatcccacgacttgcgggtgacggt

SEQ ID NO: 15357 - DNA, 25 bp, Homo sapiens
atcccacgacttgcgggtgacggtg

SEQ ID NO: 15358 - DNA, 25 bp, Homo sapiens
tcccacgacttgcgggtgacggtgg

SEQ ID NO: 15359 - DNA, 25 bp, Homo sapiens
cccacgacttgcgggtgacggtggc

SEQ ID NO: 15360 - DNA, 25 bp, Homo sapiens
ccacgacttgcgggtgacggtggcg

SEQ ID NO: 15361 - DNA, 25 bp, Homo sapiens
cacgacttgcgggtgacggtggcga

SEQ ID NO: 15362 - DNA, 25 bp, Homo sapiens
acgacttgcgggtgacggtggcgag

SEQ ID NO: 15363 - DNA, 25 bp, Homo sapiens
cgacttgcgggtgacggtggcgagc

SEQ ID NO: 15364 - DNA, 25 bp, Homo sapiens
gacttgcgggtgacggtggcgagcg

SEQ ID NO: 15365 - DNA, 25 bp, Homo sapiens
acttgcgggtgacggtggcgagcga

SEQ ID NO: 15366 - DNA, 25 bp, Homo sapiens
cttgcgggtgacggtggcgagcgaa

SEQ ID NO: 15367 - DNA, 25 bp, Homo sapiens
ttgcgggtgacggtggcgagcgaac

SEQ ID NO: 15368 - DNA, 25 bp, Homo sapiens
tgcgggtgacggtggcgagcgaacg

SEQ ID NO: 15369 - DNA, 25 bp, Homo sapiens
gcgggtgacggtggcgagcgaacgt

SEQ ID NO: 15370 - DNA, 25 bp, Homo sapiens
cgggtgacggtggcgagcgaacgtc

SEQ ID NO: 15371 - DNA, 25 bp, Homo sapiens
gggtgacggtggcgagcgaacgtcc

SEQ ID NO: 15372 - DNA, 25 bp, Homo sapiens
ggtgacggtggcgagcgaacgtccc

SEQ ID NO: 15373 - DNA, 25 bp, Homo sapiens
gtgacggtggcgagcgaacgtcccc

SEQ ID NO: 15374 - DNA, 25 bp, Homo sapiens
tgacggtggcgagcgaacgtccccc

SEQ ID NO: 15375 - DNA, 25 bp, Homo sapiens
gacggtggcgagcgaacgtcccccg

SEQ ID NO: 15376 - DNA, 25 bp, Homo sapiens
acggtggcgagcgaacgtcccccga

SEQ ID NO: 15377 - DNA, 25 bp, Homo sapiens
cggtggcgagcgaacgtcccccgag

SEQ ID NO: 15378 - DNA, 25 bp, Homo sapiens
ggtggcgagcgaacgtcccccgagc

SEQ ID NO: 15379 - DNA, 25 bp, Homo sapiens
gtggcgagcgaacgtcccccgagcg

SEQ ID NO: 15380 - DNA, 25 bp, Homo sapiens
tggcgagcgaacgtcccccgagcgg

SEQ ID NO: 15381 - DNA, 25 bp, Homo sapiens
ggcgagcgaacgtcccccgagcgga

SEQ ID NO: 15382 - DNA, 25 bp, Homo sapiens
gcgagcgaacgtcccccgagcggag

SEQ ID NO: 15383 - DNA, 25 bp, Homo sapiens
cgagcgaacgtcccccgagcggaga

SEQ ID NO: 15384 - DNA, 25 bp, Homo sapiens
gagcgaacgtcccccgagcggagag

SEQ ID NO: 15385 - DNA, 25 bp, Homo sapiens
agcgaacgtcccccgagcggagaga

SEQ ID NO: 15386 - DNA, 25 bp, Homo sapiens
gcgaacgtcccccgagcggagagag

SEQ ID NO: 15387 - DNA, 25 bp, Homo sapiens
cgaacgtcccccgagcggagagagc

SEQ ID NO: 15388 - DNA, 25 bp, Homo sapiens
gaacgtcccccgagcggagagagcc

SEQ ID NO: 15389 - DNA, 25 bp, Homo sapiens
aacgtcccccgagcggagagagcca

SEQ ID NO: 15390 - DNA, 25 bp, Homo sapiens
acgtcccccgagcggagagagccag

SEQ ID NO: 15391 - DNA, 25 bp, Homo sapiens
cgtcccccgagcggagagagccagg

SEQ ID NO: 15392 - DNA, 25 bp, Homo sapiens
gtcccccgagcggagagagccaggg

SEQ ID NO: 15393 - DNA, 25 bp, Homo sapiens
tcccccgagcggagagagccaggga

SEQ ID NO: 15394 - DNA, 25 bp, Homo sapiens
cccccgagcggagagagccagggac

SEQ ID NO: 15395 - DNA, 25 bp, Homo sapiens
ccccgagcggagagagccagggacg

SEQ ID NO: 15396 - DNA, 25 bp, Homo sapiens
cccgagcggagagagccagggacgg

SEQ ID NO: 15397 - DNA, 25 bp, Homo sapiens
ccgagcggagagagccagggacggg

SEQ ID NO: 15398 - DNA, 25 bp, Homo sapiens
cgagcggagagagccagggacgggg

SEQ ID NO: 15399 - DNA, 25 bp, Homo sapiens
gagcggagagagccagggacgggga

SEQ ID NO: 15400 - DNA, 25 bp, Homo sapiens
agcggagagagccagggacggggag

SEQ ID NO: 15401 - DNA, 25 bp, Homo sapiens
gcggagagagccagggacggggagg

SEQ ID NO: 15402 - DNA, 25 bp, Homo sapiens
cggagagagccagggacggggagga

SEQ ID NO: 15403 - DNA, 25 bp, Homo sapiens
ggagagagccagggacggggaggaa

SEQ ID NO: 15404 - DNA, 25 bp, Homo sapiens
gagagagccagggacggggaggaaa

SEQ ID NO: 15405 - DNA, 25 bp, Homo sapiens
agagagccagggacggggaggaaag

SEQ ID NO: 15406 - DNA, 25 bp, Homo sapiens
gagagccagggacggggaggaaaga

SEQ ID NO: 15407 - DNA, 25 bp, Homo sapiens
agagccagggacggggaggaaagac

SEQ ID NO: 15408 - DNA, 25 bp, Homo sapiens
gagccagggacggggaggaaagacg

SEQ ID NO: 15409 - DNA, 25 bp, Homo sapiens
agccagggacggggaggaaagacga

SEQ ID NO: 15410 - DNA, 25 bp, Homo sapiens
gccagggacggggaggaaagacgac

SEQ ID NO: 15411 - DNA, 25 bp, Homo sapiens
ccagggacggggaggaaagacgacg

SEQ ID NO: 15412 - DNA, 25 bp, Homo sapiens
cagggacggggaggaaagacgacga

SEQ ID NO: 15413 - DNA, 25 bp, Homo sapiens
agggacggggaggaaagacgacgat

SEQ ID NO: 15414 - DNA, 25 bp, Homo sapiens
gggacggggaggaaagacgacgatg

SEQ ID NO: 15415 - DNA, 25 bp, Homo sapiens
ggacggggaggaaagacgacgatgt

SEQ ID NO: 15416 - DNA, 25 bp, Homo sapiens
gacggggaggaaagacgacgatgtt

SEQ ID NO: 15417 - DNA, 25 bp, Homo sapiens
acggggaggaaagacgacgatgttg

SEQ ID NO: 15418 - DNA, 25 bp, Homo sapiens
cggggaggaaagacgacgatgttgc

SEQ ID NO: 15419 - DNA, 25 bp, Homo sapiens
ggggaggaaagacgacgatgttgcg

SEQ ID NO: 15420 - DNA, 25 bp, Homo sapiens
gggaggaaagacgacgatgttgcga

SEQ ID NO: 15421 - DNA, 25 bp, Homo sapiens
ggaggaaagacgacgatgttgcgag

SEQ ID NO: 15422 - DNA, 25 bp, Homo sapiens
gaggaaagacgacgatgttgcgagc

SEQ ID NO: 15423 - DNA, 25 bp, Homo sapiens
aggaaagacgacgatgttgcgagca

SEQ ID NO: 15424 - DNA, 25 bp, Homo sapiens
ggaaagacgacgatgttgcgagcat

SEQ ID NO: 15425 - DNA, 25 bp, Homo sapiens
gaaagacgacgatgttgcgagcata

SEQ ID NO: 15426 - DNA, 25 bp, Homo sapiens
aaagacgacgatgttgcgagcataa

SEQ ID NO: 15427 - DNA, 25 bp, Homo sapiens
aagacgacgatgttgcgagcataat

SEQ ID NO: 15428 - DNA, 25 bp, Homo sapiens
agacgacgatgttgcgagcataatg

SEQ ID NO: 15429 - DNA, 25 bp, Homo sapiens
gacgacgatgttgcgagcataatga

SEQ ID NO: 15430 - DNA, 25 bp, Homo sapiens
acgacgatgttgcgagcataatgaa

SEQ ID NO: 15431 - DNA, 25 bp, Homo sapiens
cgacgatgttgcgagcataatgaag

SEQ ID NO: 15432 - DNA, 25 bp, Homo sapiens
gacgatgttgcgagcataatgaaga

SEQ ID NO: 15433 - DNA, 25 bp, Homo sapiens
acgatgttgcgagcataatgaagaa

SEQ ID NO: 15434 - DNA, 25 bp, Homo sapiens
cgatgttgcgagcataatgaagaaa

SEQ ID NO: 15435 - DNA, 25 bp, Homo sapiens
gatgttgcgagcataatgaagaaat

SEQ ID NO: 15436 - DNA, 25 bp, Homo sapiens
atgttgcgagcataatgaagaaata

SEQ ID NO: 15437 - DNA, 25 bp, Homo sapiens
tgttgcgagcataatgaagaaatac

SEQ ID NO: 15438 - DNA, 25 bp, Homo sapiens
gttgcgagcataatgaagaaatacc

SEQ ID NO: 15439 - DNA, 25 bp, Homo sapiens
ttgcgagcataatgaagaaatacct

SEQ ID NO: 15440 - DNA, 25 bp, Homo sapiens
tgcgagcataatgaagaaatacctc

SEQ ID NO: 15441 - DNA, 25 bp, Homo sapiens
gcgagcataatgaagaaatacctcc

SEQ ID NO: 15442 - DNA, 25 bp, Homo sapiens
cgagcataatgaagaaatacctcca

SEQ ID NO: 15443 - DNA, 25 bp, Homo sapiens
gagcataatgaagaaatacctccag

SEQ ID NO: 15444 - DNA, 25 bp, Homo sapiens
agcataatgaagaaatacctccaga

SEQ ID NO: 15445 - DNA, 25 bp, Homo sapiens
gcataatgaagaaatacctccagaa

SEQ ID NO: 15446 - DNA, 25 bp, Homo sapiens
cataatgaagaaatacctccagaag

SEQ ID NO: 15447 - DNA, 25 bp, Homo sapiens
ataatgaagaaatacctccagaagt

SEQ ID NO: 15448 - DNA, 25 bp, Homo sapiens
taatgaagaaatacctccagaagta

SEQ ID NO: 15449 - DNA, 25 bp, Homo sapiens
aatgaagaaatacctccagaagtag

SEQ ID NO: 15450 - DNA, 25 bp, Homo sapiens
atgaagaaatacctccagaagtagg

SEQ ID NO: 15451 - DNA, 25 bp, Homo sapiens
tgaagaaatacctccagaagtagga

SEQ ID NO: 15452 - DNA, 25 bp, Homo sapiens
gaagaaatacctccagaagtaggaa

SEQ ID NO: 15453 - DNA, 25 bp, Homo sapiens
aagaaatacctccagaagtaggaac

SEQ ID NO: 15454 - DNA, 25 bp, Homo sapiens
agaaatacctccagaagtaggaacc

SEQ ID NO: 15455 - DNA, 25 bp, Homo sapiens
gaaatacctccagaagtaggaacca

SEQ ID NO: 15456 - DNA, 25 bp, Homo sapiens
aaatacctccagaagtaggaaccag

SEQ ID NO: 15457 - DNA, 25 bp, Homo sapiens
aatacctccagaagtaggaaccagt

SEQ ID NO: 15458 - DNA, 25 bp, Homo sapiens
atacctccagaagtaggaaccagtt

SEQ ID NO: 15459 - DNA, 25 bp, Homo sapiens
tacctccagaagtaggaaccagttc

SEQ ID NO: 15460 - DNA, 25 bp, Homo sapiens
acctccagaagtaggaaccagttca

SEQ ID NO: 15461 - DNA, 25 bp, Homo sapiens
cctccagaagtaggaaccagttcag

SEQ ID NO: 15462 - DNA, 25 bp, Homo sapiens
ctccagaagtaggaaccagttcagc

SEQ ID NO: 15463 - DNA, 25 bp, Homo sapiens
tccagaagtaggaaccagttcagcc

SEQ ID NO: 15464 - DNA, 25 bp, Homo sapiens
ccagaagtaggaaccagttcagcct

SEQ ID NO: 15465 - DNA, 25 bp, Homo sapiens
cagaagtaggaaccagttcagcctc

SEQ ID NO: 15466 - DNA, 25 bp, Homo sapiens
agaagtaggaaccagttcagcctcc

SEQ ID NO: 15467 - DNA, 25 bp, Homo sapiens
gaagtaggaaccagttcagcctcct

SEQ ID NO: 15468 - DNA, 25 bp, Homo sapiens
aagtaggaaccagttcagcctcctt

SEQ ID NO: 15469 - DNA, 25 bp, Homo sapiens
agtaggaaccagttcagcctccttg

SEQ ID NO: 15470 - DNA, 25 bp, Homo sapiens
gtaggaaccagttcagcctccttga

SEQ ID NO: 15471 - DNA, 25 bp, Homo sapiens
taggaaccagttcagcctccttgaa

SEQ ID NO: 15472 - DNA, 25 bp, Homo sapiens
aggaaccagttcagcctccttgaag

SEQ ID NO: 15473 - DNA, 25 bp, Homo sapiens
ggaaccagttcagcctccttgaagc

SEQ ID NO: 15474 - DNA, 25 bp, Homo sapiens
gaaccagttcagcctccttgaagct

SEQ ID NO: 15475 - DNA, 25 bp, Homo sapiens
aaccagttcagcctccttgaagctg

SEQ ID NO: 15476 - DNA, 25 bp, Homo sapiens
accagttcagcctccttgaagctgc

SEQ ID NO: 15477 - DNA, 25 bp, Homo sapiens
ccagttcagcctccttgaagctgcc

SEQ ID NO: 15478 - DNA, 25 bp, Homo sapiens
cagttcagcctccttgaagctgccc

SEQ ID NO: 15479 - DNA, 25 bp, Homo sapiens
agttcagcctccttgaagctgccct

SEQ ID NO: 15480 - DNA, 25 bp, Homo sapiens
gttcagcctccttgaagctgccctt

SEQ ID NO: 15481 - DNA, 25 bp, Homo sapiens
ttcagcctccttgaagctgcccttg

SEQ ID NO: 15482 - DNA, 25 bp, Homo sapiens
tcagcctccttgaagctgcccttga

SEQ ID NO: 15483 - DNA, 25 bp, Homo sapiens
cagcctccttgaagctgcccttgaa

SEQ ID NO: 15484 - DNA, 25 bp, Homo sapiens
agcctccttgaagctgcccttgaag

SEQ ID NO: 15485 - DNA, 25 bp, Homo sapiens
gcctccttgaagctgcccttgaaga

SEQ ID NO: 15486 - DNA, 25 bp, Homo sapiens
cctccttgaagctgcccttgaagac

SEQ ID NO: 15487 - DNA, 25 bp, Homo sapiens
ctccttgaagctgcccttgaagact

SEQ ID NO: 15488 - DNA, 25 bp, Homo sapiens
tccttgaagctgcccttgaagactt

SEQ ID NO: 15489 - DNA, 25 bp, Homo sapiens
ccttgaagctgcccttgaagacttc

SEQ ID NO: 15490 - DNA, 25 bp, Homo sapiens
cttgaagctgcccttgaagacttcc

SEQ ID NO: 15491 - DNA, 25 bp, Homo sapiens
ttgaagctgcccttgaagacttccc

SEQ ID NO: 15492 - DNA, 25 bp, Homo sapiens
tgaagctgcccttgaagacttcccg

SEQ ID NO: 15493 - DNA, 25 bp, Homo sapiens
gaagctgcccttgaagacttcccga

SEQ ID NO: 15494 - DNA, 25 bp, Homo sapiens
aagctgcccttgaagacttcccgac

SEQ ID NO: 15495 - DNA, 25 bp, Homo sapiens
agctgcccttgaagacttcccgact

SEQ ID NO: 15496 - DNA, 25 bp, Homo sapiens
gctgcccttgaagacttcccgactc

SEQ ID NO: 15497 - DNA, 25 bp, Homo sapiens
ctgcccttgaagacttcccgactct

SEQ ID NO: 15498 - DNA, 25 bp, Homo sapiens
tgcccttgaagacttcccgactcta

SEQ ID NO: 15499 - DNA, 25 bp, Homo sapiens
gcccttgaagacttcccgactctac

SEQ ID NO: 15500 - DNA, 25 bp, Homo sapiens
cccttgaagacttcccgactctaca

SEQ ID NO: 15501 - DNA, 25 bp, Homo sapiens
ccttgaagacttcccgactctacaa

SEQ ID NO: 15502 - DNA, 25 bp, Homo sapiens
cttgaagacttcccgactctacaat

SEQ ID NO: 15503 - DNA, 25 bp, Homo sapiens
ttgaagacttcccgactctacaata

SEQ ID NO: 15504 - DNA, 25 bp, Homo sapiens
tgaagacttcccgactctacaataa

SEQ ID NO: 15505 - DNA, 25 bp, Homo sapiens
gaagacttcccgactctacaataac

SEQ ID NO: 15506 - DNA, 25 bp, Homo sapiens
aagacttcccgactctacaataact

SEQ ID NO: 15507 - DNA, 25 bp, Homo sapiens
agacttcccgactctacaataactt

SEQ ID NO: 15508 - DNA, 25 bp, Homo sapiens
gacttcccgactctacaataacttg

SEQ ID NO: 15509 - DNA, 25 bp, Homo sapiens
acttcccgactctacaataacttgg

SEQ ID NO: 15510 - DNA, 25 bp, Homo sapiens
cttcccgactctacaataacttgga

SEQ ID NO: 15511 - DNA, 25 bp, Homo sapiens
ttcccgactctacaataacttggag

SEQ ID NO: 15512 - DNA, 25 bp, Homo sapiens
tcccgactctacaataacttggaga

SEQ ID NO: 15513 - DNA, 25 bp, Homo sapiens
cccgactctacaataacttggagac

SEQ ID NO: 15514 - DNA, 25 bp, Homo sapiens
ccgactctacaataacttggagaca

SEQ ID NO: 15515 - DNA, 25 bp, Homo sapiens
cgactctacaataacttggagacag

SEQ ID NO: 15516 - DNA, 25 bp, Homo sapiens
gactctacaataacttggagacaga

SEQ ID NO: 15517 - DNA, 25 bp, Homo sapiens
actctacaataacttggagacagag

SEQ ID NO: 15518 - DNA, 25 bp, Homo sapiens
ctctacaataacttggagacagaga

SEQ ID NO: 15519 - DNA, 25 bp, Homo sapiens
tctacaataacttggagacagagag

SEQ ID NO: 15520 - DNA, 25 bp, Homo sapiens
ctacaataacttggagacagagaga

SEQ ID NO: 15521 - DNA, 25 bp, Homo sapiens
tacaataacttggagacagagagac

SEQ ID NO: 15522 - DNA, 25 bp, Homo sapiens
acaataacttggagacagagagact

SEQ ID NO: 15523 - DNA, 25 bp, Homo sapiens
caataacttggagacagagagactg

SEQ ID NO: 15524 - DNA, 25 bp, Homo sapiens
aataacttggagacagagagactgg

SEQ ID NO: 15525 - DNA, 25 bp, Homo sapiens
ataacttggagacagagagactggc

SEQ ID NO: 15526 - DNA, 25 bp, Homo sapiens
taacttggagacagagagactggcc

SEQ ID NO: 15527 - DNA, 25 bp, Homo sapiens
aacttggagacagagagactggcca

SEQ ID NO: 15528 - DNA, 25 bp, Homo sapiens
acttggagacagagagactggccag

SEQ ID NO: 15529 - DNA, 25 bp, Homo sapiens
cttggagacagagagactggccagg

SEQ ID NO: 15530 - DNA, 25 bp, Homo sapiens
ttggagacagagagactggccaggc

SEQ ID NO: 15531 - DNA, 25 bp, Homo sapiens
tggagacagagagactggccaggcc

SEQ ID NO: 15532 - DNA, 25 bp, Homo sapiens
ggagacagagagactggccaggcct

SEQ ID NO: 15533 - DNA, 25 bp, Homo sapiens
gagacagagagactggccaggcctc

SEQ ID NO: 15534 - DNA, 25 bp, Homo sapiens
agacagagagactggccaggcctcc

SEQ ID NO: 15535 - DNA, 25 bp, Homo sapiens
gacagagagactggccaggcctccc

SEQ ID NO: 15536 - DNA, 25 bp, Homo sapiens
acagagagactggccaggcctcccc

SEQ ID NO: 15537 - DNA, 25 bp, Homo sapiens
cagagagactggccaggcctccccg

SEQ ID NO: 15538 - DNA, 25 bp, Homo sapiens
agagagactggccaggcctccccgg

SEQ ID NO: 15539 - DNA, 25 bp, Homo sapiens
gagagactggccaggcctccccggt

SEQ ID NO: 15540 - DNA, 25 bp, Homo sapiens
agagactggccaggcctccccggtg

SEQ ID NO: 15541 - DNA, 25 bp, Homo sapiens
gagactggccaggcctccccggtgg

SEQ ID NO: 15542 - DNA, 25 bp, Homo sapiens
agactggccaggcctccccggtggc

SEQ ID NO: 15543 - DNA, 25 bp, Homo sapiens
gactggccaggcctccccggtggcc

SEQ ID NO: 15544 - DNA, 25 bp, Homo sapiens
actggccaggcctccccggtggcca

SEQ ID NO: 15545 - DNA, 25 bp, Homo sapiens
ctggccaggcctccccggtggccag

SEQ ID NO: 15546 - DNA, 25 bp, Homo sapiens
tggccaggcctccccggtggccaga

SEQ ID NO: 15547 - DNA, 25 bp, Homo sapiens
ggccaggcctccccggtggccagag

SEQ ID NO: 15548 - DNA, 25 bp, Homo sapiens
gccaggcctccccggtggccagagc

SEQ ID NO: 15549 - DNA, 25 bp, Homo sapiens
ccaggcctccccggtggccagagcc

SEQ ID NO: 15550 - DNA, 25 bp, Homo sapiens
caggcctccccggtggccagagcca

SEQ ID NO: 15551 - DNA, 25 bp, Homo sapiens
aggcctccccggtggccagagccag

SEQ ID NO: 15552 - DNA, 25 bp, Homo sapiens
ggcctccccggtggccagagccagc

SEQ ID NO: 15553 - DNA, 25 bp, Homo sapiens
gcctccccggtggccagagccagcc

SEQ ID NO: 15554 - DNA, 25 bp, Homo sapiens
cctccccggtggccagagccagcca

SEQ ID NO: 15555 - DNA, 25 bp, Homo sapiens
ctccccggtggccagagccagccag

SEQ ID NO: 15556 - DNA, 25 bp, Homo sapiens
tccccggtggccagagccagccagc

SEQ ID NO: 15557 - DNA, 25 bp, Homo sapiens
ccccggtggccagagccagccagca

SEQ ID NO: 15558 - DNA, 25 bp, Homo sapiens
cccggtggccagagccagccagcat

SEQ ID NO: 15559 - DNA, 25 bp, Homo sapiens
ccggtggccagagccagccagcatg

SEQ ID NO: 15560 - DNA, 25 bp, Homo sapiens
cggtggccagagccagccagcatgg

SEQ ID NO: 15561 - DNA, 25 bp, Homo sapiens
ggtggccagagccagccagcatggc

SEQ ID NO: 15562 - DNA, 25 bp, Homo sapiens
gtggccagagccagccagcatggcc

SEQ ID NO: 15563 - DNA, 25 bp, Homo sapiens
tggccagagccagccagcatggcca

SEQ ID NO: 15564 - DNA, 25 bp, Homo sapiens
ggccagagccagccagcatggccac

SEQ ID NO: 15565 - DNA, 25 bp, Homo sapiens
gccagagccagccagcatggccacc

SEQ ID NO: 15566 - DNA, 25 bp, Homo sapiens
ccagagccagccagcatggccaccc

SEQ ID NO: 15567 - DNA, 25 bp, Homo sapiens
cagagccagccagcatggccaccct

SEQ ID NO: 15568 - DNA, 25 bp, Homo sapiens
agagccagccagcatggccaccctc

SEQ ID NO: 15569 - DNA, 25 bp, Homo sapiens
gagccagccagcatggccaccctca

SEQ ID NO: 15570 - DNA, 25 bp, Homo sapiens
agccagccagcatggccaccctcaa

SEQ ID NO: 15571 - DNA, 25 bp, Homo sapiens
gccagccagcatggccaccctcaag

SEQ ID NO: 15572 - DNA, 25 bp, Homo sapiens
ccagccagcatggccaccctcaaga

SEQ ID NO: 15573 - DNA, 25 bp, Homo sapiens
cagccagcatggccaccctcaagag

SEQ ID NO: 15574 - DNA, 25 bp, Homo sapiens
agccagcatggccaccctcaagagg

SEQ ID NO: 15575 - DNA, 25 bp, Homo sapiens
gccagcatggccaccctcaagaggc

SEQ ID NO: 15576 - DNA, 25 bp, Homo sapiens
ccagcatggccaccctcaagaggcg

SEQ ID NO: 15577 - DNA, 25 bp, Homo sapiens
cagcatggccaccctcaagaggcga

SEQ ID NO: 15578 - DNA, 25 bp, Homo sapiens
agcatggccaccctcaagaggcgag

SEQ ID NO: 15579 - DNA, 25 bp, Homo sapiens
gcatggccaccctcaagaggcgaga

SEQ ID NO: 15580 - DNA, 25 bp, Homo sapiens
catggccaccctcaagaggcgagat

SEQ ID NO: 15581 - DNA, 25 bp, Homo sapiens
atggccaccctcaagaggcgagatg

SEQ ID NO: 15582 - DNA, 25 bp, Homo sapiens
tggccaccctcaagaggcgagatga

SEQ ID NO: 15583 - DNA, 25 bp, Homo sapiens
ggccaccctcaagaggcgagatgag

SEQ ID NO: 15584 - DNA, 25 bp, Homo sapiens
gccaccctcaagaggcgagatgagc

SEQ ID NO: 15585 - DNA, 25 bp, Homo sapiens
ccaccctcaagaggcgagatgagcc

SEQ ID NO: 15586 - DNA, 25 bp, Homo sapiens
caccctcaagaggcgagatgagccc

SEQ ID NO: 15587 - DNA, 25 bp, Homo sapiens
accctcaagaggcgagatgagccca

SEQ ID NO: 15588 - DNA, 25 bp, Homo sapiens
ccctcaagaggcgagatgagcccac

SEQ ID NO: 15589 - DNA, 25 bp, Homo sapiens
cctcaagaggcgagatgagcccaca

SEQ ID NO: 15590 - DNA, 25 bp, Homo sapiens
ctcaagaggcgagatgagcccacag

SEQ ID NO: 15591 - DNA, 25 bp, Homo sapiens
tcaagaggcgagatgagcccacaga

SEQ ID NO: 15592 - DNA, 25 bp, Homo sapiens
caagaggcgagatgagcccacagag

SEQ ID NO: 15593 - DNA, 25 bp, Homo sapiens
aagaggcgagatgagcccacagagg

SEQ ID NO: 15594 - DNA, 25 bp, Homo sapiens
agaggcgagatgagcccacagaggc

SEQ ID NO: 15595 - DNA, 25 bp, Homo sapiens
gaggcgagatgagcccacagaggca

SEQ ID NO: 15596 - DNA, 25 bp, Homo sapiens
aggcgagatgagcccacagaggcat

SEQ ID NO: 15597 - DNA, 25 bp, Homo sapiens
ggcgagatgagcccacagaggcata

SEQ ID NO: 15598 - DNA, 25 bp, Homo sapiens
gcgagatgagcccacagaggcatat

SEQ ID NO: 15599 - DNA, 25 bp, Homo sapiens
cgagatgagcccacagaggcatatc

SEQ ID NO: 15600 - DNA, 25 bp, Homo sapiens
gagatgagcccacagaggcatatcc

SEQ ID NO: 15601 - DNA, 25 bp, Homo sapiens
agatgagcccacagaggcatatcct

SEQ ID NO: 15602 - DNA, 25 bp, Homo sapiens
gatgagcccacagaggcatatcctg

SEQ ID NO: 15603 - DNA, 25 bp, Homo sapiens
atgagcccacagaggcatatcctgc

SEQ ID NO: 15604 - DNA, 25 bp, Homo sapiens
tgagcccacagaggcatatcctgcg

SEQ ID NO: 15605 - DNA, 25 bp, Homo sapiens
gagcccacagaggcatatcctgcgg

SEQ ID NO: 15606 - DNA, 25 bp, Homo sapiens
agcccacagaggcatatcctgcggg

SEQ ID NO: 15607 - DNA, 25 bp, Homo sapiens
gcccacagaggcatatcctgcgggg

SEQ ID NO: 15608 - DNA, 25 bp, Homo sapiens
cccacagaggcatatcctgcgggga

SEQ ID NO: 15609 - DNA, 25 bp, Homo sapiens
ccacagaggcatatcctgcggggat

SEQ ID NO: 15610 - DNA, 25 bp, Homo sapiens
cacagaggcatatcctgcggggatg

SEQ ID NO: 15611 - DNA, 25 bp, Homo sapiens
acagaggcatatcctgcggggatgc

SEQ ID NO: 15612 - DNA, 25 bp, Homo sapiens
cagaggcatatcctgcggggatgct

SEQ ID NO: 15613 - DNA, 25 bp, Homo sapiens
agaggcatatcctgcggggatgctg

SEQ ID NO: 15614 - DNA, 25 bp, Homo sapiens
gaggcatatcctgcggggatgctgg

SEQ ID NO: 15615 - DNA, 25 bp, Homo sapiens
aggcatatcctgcggggatgctggg

SEQ ID NO: 15616 - DNA, 25 bp, Homo sapiens
ggcatatcctgcggggatgctgggc

SEQ ID NO: 15617 - DNA, 25 bp, Homo sapiens
gcatatcctgcggggatgctgggct

SEQ ID NO: 15618 - DNA, 25 bp, Homo sapiens
catatcctgcggggatgctgggctc

SEQ ID NO: 15619 - DNA, 25 bp, Homo sapiens
atatcctgcggggatgctgggctcc

SEQ ID NO: 15620 - DNA, 25 bp, Homo sapiens
tatcctgcggggatgctgggctccc

SEQ ID NO: 15621 - DNA, 25 bp, Homo sapiens
atcctgcggggatgctgggctccca

SEQ ID NO: 15622 - DNA, 25 bp, Homo sapiens
tcctgcggggatgctgggctcccag

SEQ ID NO: 15623 - DNA, 25 bp, Homo sapiens
cctgcggggatgctgggctcccagt

SEQ ID NO: 15624 - DNA, 25 bp, Homo sapiens
ctgcggggatgctgggctcccagtg

SEQ ID NO: 15625 - DNA, 25 bp, Homo sapiens
tgcggggatgctgggctcccagtgt

SEQ ID NO: 15626 - DNA, 25 bp, Homo sapiens
gcggggatgctgggctcccagtgtg

SEQ ID NO: 15627 - DNA, 25 bp, Homo sapiens
cggggatgctgggctcccagtgtgg

SEQ ID NO: 15628 - DNA, 25 bp, Homo sapiens
ggggatgctgggctcccagtgtggt

SEQ ID NO: 15629 - DNA, 25 bp, Homo sapiens
gggatgctgggctcccagtgtggtt

SEQ ID NO: 15630 - DNA, 25 bp, Homo sapiens
ggatgctgggctcccagtgtggttg

SEQ ID NO: 15631 - DNA, 25 bp, Homo sapiens
gatgctgggctcccagtgtggttgg

SEQ ID NO: 15632 - DNA, 25 bp, Homo sapiens
atgctgggctcccagtgtggttggc

SEQ ID NO: 15633 - DNA, 25 bp, Homo sapiens
tgctgggctcccagtgtggttggcc

SEQ ID NO: 15634 - DNA, 25 bp, Homo sapiens
gctgggctcccagtgtggttggcct

SEQ ID NO: 15635 - DNA, 25 bp, Homo sapiens
ctgggctcccagtgtggttggcctg

SEQ ID NO: 15636 - DNA, 25 bp, Homo sapiens
tgggctcccagtgtggttggcctga

SEQ ID NO: 15637 - DNA, 25 bp, Homo sapiens
gggctcccagtgtggttggcctgaa

SEQ ID NO: 15638 - DNA, 25 bp, Homo sapiens
ggctcccagtgtggttggcctgaac

SEQ ID NO: 15639 - DNA, 25 bp, Homo sapiens
gctcccagtgtggttggcctgaaca

SEQ ID NO: 15640 - DNA, 25 bp, Homo sapiens
ctcccagtgtggttggcctgaacaa

SEQ ID NO: 15641 - DNA, 25 bp, Homo sapiens
tcccagtgtggttggcctgaacaaa

SEQ ID NO: 15642 - DNA, 25 bp, Homo sapiens
cccagtgtggttggcctgaacaaaa

SEQ ID NO: 15643 - DNA, 25 bp, Homo sapiens
ccagtgtggttggcctgaacaaaat

SEQ ID NO: 15644 - DNA, 25 bp, Homo sapiens
cagtgtggttggcctgaacaaaata

SEQ ID NO: 15645 - DNA, 25 bp, Homo sapiens
agtgtggttggcctgaacaaaataa

SEQ ID NO: 15646 - DNA, 25 bp, Homo sapiens
gtgtggttggcctgaacaaaataaa

SEQ ID NO: 15647 - DNA, 25 bp, Homo sapiens
tgtggttggcctgaacaaaataaag

SEQ ID NO: 15648 - DNA, 25 bp, Homo sapiens
gtggttggcctgaacaaaataaagt

SEQ ID NO: 15649 - DNA, 25 bp, Homo sapiens
tggttggcctgaacaaaataaagtg

SEQ ID NO: 15650 - DNA, 25 bp, Homo sapiens
ggttggcctgaacaaaataaagtgt

SEQ ID NO: 15651 - DNA, 25 bp, Homo sapiens
gttggcctgaacaaaataaagtgtt

SEQ ID NO: 15652 - DNA, 25 bp, Homo sapiens
ttggcctgaacaaaataaagtgttg

SEQ ID NO: 15653 - DNA, 25 bp, Homo sapiens
tggcctgaacaaaataaagtgttga

SEQ ID NO: 15654 - DNA, 25 bp, Homo sapiens
ggcctgaacaaaataaagtgttgac

SEQ ID NO: 15655 - DNA, 25 bp, Homo sapiens
gcctgaacaaaataaagtgttgact

SEQ ID NO: 15656 - DNA, 25 bp, Homo sapiens
cctgaacaaaataaagtgttgactc

SEQ ID NO: 15657 - DNA, 25 bp, Homo sapiens
ctgaacaaaataaagtgttgactcc

SEQ ID NO: 15658 - DNA, 25 bp, Homo sapiens
tgaacaaaataaagtgttgactcct

SEQ ID NO: 15659 - DNA, 25 bp, Homo sapiens
gaacaaaataaagtgttgactcctg

SEQ ID NO: 15660 - DNA, 25 bp, Homo sapiens
aacaaaataaagtgttgactcctgg

SEQ ID NO: 15661 - DNA, 25 bp, Homo sapiens
acaaaataaagtgttgactcctggg

SEQ ID NO: 15662 - DNA, 25 bp, Homo sapiens
caaaataaagtgttgactcctgggc

SEQ ID NO: 15663 - DNA, 25 bp, Homo sapiens
aaaataaagtgttgactcctgggca

SEQ ID NO: 15664 - DNA, 60 bp, Homo sapiens
cacccggggagacgtcttagacagtcgtggttcctgtgatctgtgtcctctttgcagaag

SEQ ID NO: 15665 - DNA, 148 bp, Homo sapiens
ttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaag

SEQ ID NO: 15666 - DNA, 159 bp, Homo sapiens
attcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagag

SEQ ID NO: 15667 - DNA, 1314 bp, Homo sapiens
atcccagaaatttccatcagccaacccaacagcaagtccagcagtggcaccagatctggaagccagcagatctctcaggacgaccagtcaagctctcctgggagctcagacattctgggcaaggagagcgaggggtcccgcagccccgaccctgagcagatgacaagcatcaatggtgagaaggcccaggagctgggctccagtgcgacaccaaccaaaaagactgtccccttcaagaggggcgtgaggaggggtgatgtgttgttgatggtggccaagctggacccggactcagccaagccagagaagactcatccccatgacgcccccccttgcaagacctctccccccgccacagatactggaaaggaaaagaaaggggagacctctaggactccttgtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggggacgatctgagaatgggggagaaagcaggtgagcttcggagcacgactgggaaggcaggtgagtcctgggataagaaggaaaagatggggcaaccccagggtaagtccgggaacgcaggtgaagctcggagtcagacagagaagggctgtgaagccccaaaggaggtgagcacaatggtggagtcgccagcagctcctgggaagggaggctggccaggaagccgtgggcaggaagcagaggagccctgctcaagagcaggtgatggggctggtgccctggagacagagctggaaggacccagccagcctgctctggagaaggatgcagaaaggcctcggatacggaaggagaaccaagacgggccagccccgcaggaggagggcaaaggaggccagagcagagactcagaccag

SEQ ID NO: 15668 - DNA, 67 bp, Homo sapiens
gctcctgaggacagatggtatgaggcagagaaagtctggctggctcagaaggatggatttactcttg

SEQ ID NO: 15669 - DNA, 113 bp, Homo sapiens
ctacggtgctaaagccagatgagggaacagcagacctgccagcaggaagggtgagactttgcattgatgctgacaaaaccatcactgaggtggatgaggagcatgtccatcgg

SEQ ID NO: 15670 - DNA, 177 bp, Homo sapiens
gccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaag

SEQ ID NO: 15671 - DNA, 199 bp, Homo sapiens
gtgcccaagggccgccgggatggcctgcctgcccacattggctccatggcacagcgggcatactgggcgctgctgaaccagcggagagaccagagcattgtggccctgggccggagtggcgctgggaagaccacctgctgtgagcaggtcctggaacacctggtggggatggcaggcagtgtggatggcagggtctcag

SEQ ID NO: 15672 - DNA, 143 bp, Homo sapiens
tggagaagatccgagccaccttcactgtcctccgggccttcggctctgtgtccatggcccacagccgcagtgccacccggttctccatggtgatgtcgctggacttcaacgctacaggccgcatcacagctgctcagctccag

SEQ ID NO: 15673 - DNA, 101 bp, Homo sapiens
acaatgcttttggagaagagccgcgtggcacggcagccggaaggggaaagtaacttcctggttttctcccagatgctggctggattggacttggatctcag

SEQ ID NO: 15674 - DNA, 64 bp, Homo sapiens
gacggagctgaacctgcaccagatggcagatagcagctcctttggcatgggcgtgtggtccaag

SEQ ID NO: 15675 - DNA, 145 bp, Homo sapiens
cctgaagataaacagaaggcggcagctgcctttgcccagctccagggtgccatggagatgctgggcatctcagagagcgagcagcgggctgtttggcgggtcctggcagccatctaccacctgggcgcggcgggggcctgcaaag

SEQ ID NO: 15676 - DNA, 174 bp, Homo sapiens
tgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcag

SEQ ID NO: 15677 - DNA, 91 bp, Homo sapiens
ggctcaagatgacaggagtggactgtgtggaggggatggcctcgggcctgtaccaggaactctttgcggctgtggtctcactcatcaacag

SEQ ID NO: 15678 - DNA, 193 bp, Homo sapiens
atccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagag

SEQ ID NO: 15679 - DNA, 81 bp, Homo sapiens
gaaggtgttcctgtgcagtttgacctcccggacccctccccagggaccaccgtggctgttgtggatcaaaatccctctcag

SEQ ID NO: 15680 - DNA, 151 bp, Homo sapiens
caggtccgcttaccagctggaggaggtgcccaggatgccagaggccttttctgggtcttagatgaggaagtccatgtagagggctccagtgacagtgtggtgctcgagcgtctgtgtgctactttcgagaagaaaggagctgggactgaag

SEQ ID NO: 15681 - DNA, 160 bp, Homo sapiens
ggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaacagtcaaaaag

SEQ ID NO: 15682 - DNA, 184 bp, Homo sapiens
agaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatg

SEQ ID NO: 15683 - DNA, 223 bp, Homo sapiens
gatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacag

SEQ ID NO: 15684 - DNA, 110 bp, Homo sapiens
gctatgctgaccacatggggctcactcgcttccgccggcaattccaggtgctggacgctccactcctgaagaagctcatgtcgacctccgagggaatagatgaaaggaag

SEQ ID NO: 15685 - DNA, 66 bp, Homo sapiens
gccgtggaggagctcctggagaccctggatctggaaaagaaggcggtggctgtggggcacagccaa

SEQ ID NO: 15686 - DNA, 129 bp, Homo sapiens
gtttttctcaaggcaggtgtgatctccaggcttgagaagcagcgagagaagctggtatctcagagcatcgttctcttccaggcggcttgcaagggctttctgtctcgccaggaattcaagaagctgaag

SEQ ID NO: 15687 - DNA, 144 bp, Homo sapiens
attcgccgactggctgcacagtgcatccagaagaatgtggctgtgttcctcgcagtcaaggactggccatggtggcagctgcttggttccctccagcctctacttagtgccaccattggaactgagcagctccgagccaaggag

SEQ ID NO: 15688 - DNA, 90 bp, Homo sapiens
gaggagcttacaacgctaagacggaagctagaaaaatcagagaagttgcggaatgaactccggcagaacacagatctgctagaaagcaag

SEQ ID NO: 15689 - DNA, 120 bp, Homo sapiens
attgctgacttgacctctgaccttgccgatgagcgcttcaaaggtgatgtggcctgccaggtgctggagagtgagcgggcagagcggctacaggccttccgggaggtccaggagctcaag

SEQ ID NO: 15690 - DNA, 109 bp, Homo sapiens
agcaagcatgaacaagtccagaaaaaactgggagatgtgaataaacagttggaagaagcccagcagaaaattcagttgaatgacttggaaagggatcccactggaggag

SEQ ID NO: 15691 - DNA, 125 bp, Homo sapiens
cagacgagtggcagatgcgcttcgactgtgctcagatggagaacgagttcctcagaaagcgtctgcagcaatgcgaggagaggctggactcggagctgacagccaggaaagagctggagcaaaag

SEQ ID NO: 15692 - DNA, 155 bp, Homo sapiens
cttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaa

SEQ ID NO: 15693 - DNA, 124 bp, Homo sapiens
gtttgacctgcagctggcccaggccctaggtgagtcagtgtttgagaagggtctccgtgagaaagtgacccaggagaacaccagtgtccggtgggagctaggccagcttcagcagcagctgaag

SEQ ID NO: 15694 - DNA, 201 bp, Homo sapiens
caaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcag

SEQ ID NO: 15695 - DNA, 111 bp, Homo sapiens
ctccgccagcggtttgagctggagatcgagcggatgaagcagatgcaccagaaggaccgtgaggaccaggaggaggaactggaggatgtccgtcagtcctgccagaagcgg

SEQ ID NO: 15696 - DNA, 105 bp, Homo sapiens
cttcatcagctggaaatgcagctggagcaagagtatgaagagaagcagatggtcctccatgagaagcaagatttggaaggcttgatcggaaccctctgtgaccag

SEQ ID NO: 15697 - DNA, 153 bp, Homo sapiens
attggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccag

SEQ ID NO: 15698 - DNA, 114 bp, Homo sapiens
ctggagcagagtgaagccaagtgtgaggaggccttgaagacgcagaaggtgctcacagcggacctggagagcatgcacagcgagctggagaacatgacgcggaacaagagcctg

SEQ ID NO: 15699 - DNA, 117 bp, Homo sapiens
gtggatgagcagctgtacaggctgcagtttgagaaggcggacctcctgaagcgcatcgatgaggaccaggatgacctgaatgagctgatgcagaagcacaaggacctcattgctcag

SEQ ID NO: 15700 - DNA, 84 bp, Homo sapiens
tctgctgctgacattgggcagatccaagaactgcagctgcagctggaggaagccaagaaggagaagcacaagctacaagaacaa

SEQ ID NO: 15701 - DNA, 138 bp, Homo sapiens
ctgcaggtggctcagatgcgcatcgagtacctggaacagtccaccgtggatcgagccatcgtcagcaggcaggaggcggtcatctgtgacctagagaacaagacagagttccagaaggtgcagattaagagatttgag

SEQ ID NO: 15702 - DNA, 186 bp, Homo sapiens
gtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctg

SEQ ID NO: 15703 - DNA, 131 bp, Homo sapiens
gagaagtacgtggaggaacttgcagcagtgaggcaaaccctccagacagacctggagacatccattcggcggattgccgacctgcaggctgccttggaagaagtggcatccagtgacagtgatactgagag

SEQ ID NO: 15704 - DNA, 45 bp, Homo sapiens
tgtccagacggcagtggattgtggcagcagcggccgaaaagagat

SEQ ID NO: 15705 - DNA, 138 bp, Homo sapiens
ggataacgtctccatcctcagctcccagccagagggcagcctgcagtcctggttgagctgtactctgtccctggccacagatactatgaggactccttctcgacagtcagccaccagcagccgcatcctcagccccag

SEQ ID NO: 15706 - DNA, 1246 bp, Homo sapiens
gataaacgaagaggctggggacactgagaggacccagtcggcattggcactgagcagagcccggtccaccaatgtccacagcaagacctcaggagacaagcctgtttctccccactttgtccgccggcaaaagtactgtcattttggggacggcgaagtgcttgccgtccagagaaagtccacagagagattagaacctgcttcctctcccctggcttctcggagtacaaatacatccccgctgtcgagggaaaagctgcccagtccttcagcggccctctcggagttcgtggaagggctccggaggaagagagcccagagaggccaggggtccacgctgggcctagaggactggcccactctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgacttcctcccagctatccggaagccccagacacctacctccttggctggatcagccaaaggtgggcaagacggttcacagcgttcaagcatccactttgaaacggaagaggctaaccgttcctttctctcggggatcaagaccattttgaagaagagcccggagcccaaggaggatcccgctcacctgtctgactcgtcctcatcctccggctccatcgtgtccttcaaaagtgctgacagcatcaaaagtcgaccaggaatcccacgacttgcgggtgacggtggcgagcgaacgtcccccgagcggagagagccagggacggggaggaaagacgacgatgttgcgagcataatgaagaaatacctccagaagtaggaaccagttcag

SEQ ID NO: 15707 - DNA, 202 bp, Homo sapiens
cctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggca

SEQ ID NO: 15708 - DNA, 500 bp, Homo sapiens
tcaacggccaccccgggctgccgtctcctggccagacctggagctcacaagctaattttagaaatgactggtcgactcagctgctgctatcacattggcccagaaggagggtggggggaggacgggtcggggaggggcagtaaggggaagggatgtgtgtcggtgtgtgtggagagggtgctccttcgctcctgctttcccggctcggtggggtcccttcgcggccacccggggagacgtcttagacagtcgtggttcctgtgatctgtgtcctctttgcagaaggtactattgggctgggttttagacgggcaccttgcgagcggatcggcgagttttaattttccggaatgcgctgctgggggctgcggtggcaggcctccggtcttttggtctattttaggcctttctggtgttgagagcttccgaggcctgattcctttgcctgttgcccgtgctgctcactttgaaaacaagagtgtttcggtggaaggatttga

SEQ ID NO: 15709 - DNA, 500 bp, Homo sapiens
tgcctgaccatcctccttgcagaggtagctgacagtgtctgtacctgactgtgcccattcccccatgtggtcttggtttatggcgttggtgggggtgggagtagggctgtgcccatgagctaacctgtctctctcttctctccccactgtgtccctgtgtgtcagttctgtgtccatctcatgtgctgcgtgtgtctgtaaagcctcattccgtgctgtctggcaggaagctccatctcatctcatcatctcacggccctggcactgcctcagcatggccatctcatcacgcctcgccctgtgggagcagaaggaaagtgacactcatggctggggctgcagccatctgcagggactgactcgaccctcgggagacaagtccgacctttcccaccttgagtggggagtctgacatccagccctcctagtagcatgtgcaatcccaccttcaaccttctcccagccagctcggttagccttggcctttccaacccagctgg

SEQ ID NO: 15710 - DNA, 500 bp, Homo sapiens
acccccctgagtcgtgctgggcctcacctgcttggctgtggcttctcatacatgggcttggtcatgtatgtctcctccgccccctcccaggctccatcacaaactttgaagggcagcttgctcctgctggttgactcactgagctctctctttccttgcttctgcaaaacagattcgggaagaggacaagagccctccaccatcctcgccccctcctcttttctctgtcatcccagggggcttcattaagcaactggtccgggggactgaaaaagaggccaaggaagcgagacagaggaagcagttagctgtcgcctctccagaacgagaggtaagtggttcctaagaaggaggaccgtatgcgtttccatacccatcattctgtcttgtgagcttcctctgagtcatttgtcatcctgcctttgctcctgctgtcctggttttgaggaatgtcctttattcaacttgatctattgagctcttatgtacccttcaaaacc

SEQ ID NO: 15711 - DNA, 500 bp, Homo sapiens
gtggctcccaggccagcaccgagatcttggccccgaaagctgagaagacccggactgggggtcttggggacccaggccaaggaactgtggcactgaaaaaaggcgaggagggtcaaagcatagtggggaaggggcttgggacccccaagaccacagagctgaaagaggctgagccccagggcaaagacaggcaggggaccaggccccaagcccaagggcccggcgagggggtgcgaccagggaaagcagagaaggagggagcagagcccacaaacacggtggaaaaggggaatgtctctaaggacgtagggagtgaagggaagcacgtaaggccccaaatccctgggagaaagtggggaggtttcctgggaagaaggagtaagtgggacggtccccagaataagaaggacaaagaaggggtgctcttaagtaaggcagagaagacaggtgagcctcagacccagatggagaagacaagccaagtgcagggcgagttgggg

SEQ ID NO: 15712 - DNA, 500 bp, Homo sapiens
ggagtcttgctctgtcacccaggctagatggtgcagtggtgtgatctcggctccacctcccgggtccgcaacgggaatctgcatttaaataagcacactccctctcctgttctcccccaggagattctggtttagatggctccagagcacactgtgagaaacccccgtgtaaggtagaagatgggcagcggtgccatttgctggtttaatttacgtgatgttggttctcaggctcctgaggacagatggtatgaggcagagaaagtctggctggctcagaaggatggatttactcttggtaagtaggggtgttagcacctttggagggtctgagtcttctcctgtgccccctactgctgccagccatatgttccaggtcctgattatactttggtggtcaggagggaagaggagcagtggagactgtctttcaaaggcatttgtgtcttgataatgagttatttacctactgtaactcactaatgcaacaagcatgcttt

SEQ ID NO: 15713 - DNA, 500 bp, Homo sapiens
gagtcagacttagcctgaccttaaaggatttggggtcacaactcagctccaagtgaatagaccccaaatggagacctgtcccaagccttctcccaagcttgctggcccggcttagagcctctcttatctcctgccctcgcctctttcccctcttcccctcccatctcctccccgttccccttctctctctgggatgtccaaccagctacggtgctaaagccagatgagggaacagcagacctgccagcaggaagggtgagactttggattgatgctgacaaaaccatcactgaggtggatgaggagcatgtccatcgggtgagtcccctgtcccgccgtcccccagcatgagtcccctgtcccacttcaccccagctccataccctccttccccagtcctgcaagagatttccttgttcctgactaccaataccattttggcttgatgccctggagggagttatagtgaagaaccccactgaactcattgctctactgga

SEQ ID NO: 15714 - DNA, 500 bp, Homo sapiens
tagggcttcattgctttccatccagagtccctgtgctctgttctggtctttggcacatagctctcaagaggagggcttagtgtgtgtttggttgcgggggggtggggtgggggcagggggccagaaggccagaaggccagaggagactctgtgtgatggtttcacaggccaaccctcctgagctggaccaggtcgaggacctggcctctctcatcagtgtcaacgaatccagtgtcctgaacacgcttctgcagcgctacaaagctcagctgctgcacacctgcacagggcctgatctgattgtcctccagccccgggggccctcggtgccttctgcagggaaggtgaggtgggaccattgtgggcagggctgaggggctgagggcaggggggcctggggggatccctctgcatctgaggtgacagtagaaccatcagagcccccagtcgacctgtctgcaagcagcatccttctcgcggcattgtggcatcctgtggca

SEQ ID NO: 15715 - DNA, 500 bp, Homo sapiens
gggagtcagggatctggaggcagatctggaggcagggacacagatctggaccctaggcctggggcggggcgctgtcttagaatgctccctaggcagtggctggatgggatggctgatacctgtgatcttcctgcaggtgcccaagggccgccgggatggcctgcctgcccacattggctccatggcacagcgggcatactgggcgctgctgaaccagcggagagaccagagcattgtggccctgggctggagtggcgctgggaagaccacctgctgtgagcaggtcctggaacacctggtggggatggcaggcagtgtggatggcagggtctcaggtatggtggtctctaggtgacatggagagttggggtcagcacggggagagttggaaggggatgctgagctgctttcttatattcattcagctagcattcactgagcaccagatatgtgcagaccccatgcttgctactgggcagggctatccctaggtcattggg

SEQ ID NO: 15716 - DNA, 500 bp, Homo sapiens
aatgtatgtggtttatagttgggttgggcagggagtgggtggcaggaagctcacaggaagcccaccgggggctgaggccaggatggggactggcccaagcaggggccgtggaaaaggtggacctgtgtgaggtggcagtggcagcacctgggccatcagtgacatgtggccccatgctgcccccaacagtggagaagatccgagccaccttcactgtcctccgggccttcggctctgtgtccatggcccacagccgcagtgccacccggttctccatggtgatgtcgctggacttcaacgctacaggccgcatcacagctgctcagctccaggtgaggcctctcgggggatgtgcaagggggcccttggggctgctgtgtctctaaccccgggactcagcagagcccacgcctccagctgggactctaggatgtgtctgaaatggtcatggcggtggctcaggcctgtaatcccagcactttgggaggctgaggtgggtg

SEQ ID NO: 15717 - DNA, 500 bp, Homo sapiens
gtgaagctgggaggcggagcttgcagtgagccgagatcacgccaccgcactccagcctgggcaacagagcgagactccgtctcaaaaaaaaaaaaaaaagagtggatcagagtggggcaccccaatggggcttctgggtagctgcacttcaggcatgtgcagatgtacccaaagcactgactgggtgcccctcttctctccctgcagacaatgcttttggagaagagccgcgtggcacggcagccggaaggggaaagtaacttcctggttttctcccagatgctggctggattggacttggatctcaggtgagcacttggggcaggaagagacagctgagggcagtgcgacaaagggcacatgttctttgggggcccagccttagcttctgcccagcactgagaggccgtgggacccagggattaggaacatggcgtccgattccagctgtctgggtacacgcagctcatgggctgggtgactttggtcacatgtcatcc

SEQ ID NO: 15718 - DNA, 500 bp, Homo sapiens
tacaaccctttctcctgggatttcctggcctttaggaagggccaagtgagggctgtgcgtgaggaatatttgggagattgaagatatcccagggcagagttagtggggccaaggccagggacagggacagcccctggggtgtccgggcagttgtgtggagcctcacactgtgacgaccacctgccctgccagggctggtgtggacagcccccctgactcctggttccttctgtgcttccaggacggagctgaacctgcaccagatggcagatagcagctcctttggcatgggcgtgtggtccaaggtaaggaggaggtccctcacgggtgggatgtgagtctgtgtctggggctagatgggagggtgatgagtcgccgtgcaacttgtctcttttggtactggggttcatagttggcaagggttggtcatgtggaagagttggcactgcctttgtagggtctcggcttattgggtaaagaagactcagacaaataaagga

SEQ ID NO: 15719 - DNA, 500 bp, Homo sapiens
cgcctgagtttgtctgtcagtactcctcagcttaattgtgggtaatttattgtggcaataaaatgacccccgcattccttcgagacggagctcagcttcaagttgtgagcttgtgttttctccatcgcgatggccttgttttcttcctctctccctttgcccgcagcctgaagataaacagaaggcggcagctgcctttgcccagctccagggtgccatggagatgctcggcatctcagagagcgagcagcgggctgtttggcgggtcctggcagccatctaccacctgggtgcggcgggggcctgcaaaggtacgtccttcctgccgggctcacctgggagggcagctgtctcctttggcaggtgcctgacaaggcccttctctcggagcggtgggaacagggtcaatctgtcaccttctatgtctctgggacttcccttggggaggctgctgaaactaggcgtcgtgaggaggacacagggctggcttttcaagcaaa

SEQ ID NO: 15720 - DNA, 500 bp, Homo sapiens
gcagttgtccaagctcccggctgaggaggctggcctggagattgggagggtgctgagattctccgaggtcctctcgggtgttcattcaccccatgcccaaggcctcactgccacgcctctgttttgtcccctttgcagtgggtcggaagcagttcatgaggtttgagtgggcaaactacgcagctgaggccctgggctgcgagtatgaggagctgaacacggccaccttcaagcaccaccttcgacagatcatccagcaaatgacgtttgggccaagccgatggggcctcgaggatgaggaaaccagctcaggtacatggctgctgcctctttgggtgagctgggcccccctctgggccagctcctggggatacaccagcattctttaacttttttatcaaagatttgttaagggcctatgctatgaaggcgtgtgttagatgcaggggaagccatcgtgggtggaaagggaccggtcaatgctaatgctcaaataacta

SEQ ID NO: 15721 - DNA, 500 bp, Homo sapiens
cactctggggtgaaggtagggcaggttacataggacgctgtaggccctgaaaggacacttagactttgtcctaagaacctggggaaataattttagcagtggagggatgtggcaagaaaagaaggattttctaaattgagtggtccctactgctctgcagtgatgtccttggccccaggcaagatccctaaccaagaatgctgattctgtcctctttcccagggctcaagatgacaggagtggactgtgtggaggggatggcctcgggcctgtaccaggaactctttgcggctgtggtctcactcatcaacaggtaacggggccttttcctaggcacacagttggcctcttgcaggtgcacagatgaattcacataccgggcagttgaacaaagtggcagtttttgagctggcgagagggtttctaaggtggacagtgctgggtttaacttctaccttggccacccactggctgtgaggtcggcaaatcagttcacttct

SEQ ID NO: 15722 - DNA, 500 bp, Homo sapiens
tttgaaaccagttctgctggaggcttggatcagtgtgctcctagattccatgccatctcagacattccacctctctcttctctccctagatccttttcctcccaccatctctccatggcctccatcatggtggtggactctccaggcttccagaacccccggcaccagggcaaggaccgggcggccacctttgaggagctgtgccacaactacgcccatgagcgcctgcagctgctgttctaccagcggacctttgtctccacgctacagcgatatcaagaggtatgcctgggctggagcagggctttcaccagagctccgtggatggtgtaaggtcagatgggaaggggtgggattcccattccccaggagcctgcagcttcaccctgtttggttcaccagagaacaaagccctttccccaggcctggctccccagacctctgttgctccctccacagcccagcctccccctgccaccttctgaaccccgcagcccaga

SEQ ID NO: 15723 - DNA, 500 bp, Homo sapiens
atgaatgtaccttataccactgaaatgtatacttaaaatgactaaaatggtaaattttctgctatgtatcttttgccaaaatttaaaaaaacgatttttttaaagggccaagaggtgatggaaatcctctccgctttttccttcttcagaagttttcttcccccttcagctcgctaaaagtgctaacttttaaatcctgttattttccaggaaggtgttcctgtgcagtttgacctcccggacccctccccagggaccaccgtggctgttgtggatcaaaatccctctcaggtaacacagggcccagccaatccaggctctcagatgccagttggccatattgaaatgctggtggatttgagtcttcagtctactagttgtcaatgccgtgtgcacctagagtcaccccgggatcattggcaacgtggatgcctgggacccaaccccagattctgtgtaaattgttctgagggtatggcctgaacagtggaaatttaagc

SEQ ID NO: 15724 - DNA, 500 bp, Homo sapiens
tgagagtctggggtgattgggagcatggttttgggtaggcacgttctgagtcctgacacttgggacttggatgctctcattccctatcggtgggaagagaagcccaagacaggcttctgatgggtatcagggcccttcagtgaatcctggttctcccagcaggtccgcttaccagctggaggaggtgcccaggatgccagaggccttttctgggtcttagatgaggaagtccatgtagagggctccagtgacagtgtggtgctcgagcgtctgtgtgctgctttcgagaagaaaggagctgggactgaaggtaaggaagcagggggctggggatggggcctgagtccagcctgggtattagaatctgttcttctctgctgcagggaaagccctgacaaggcctgcacagaggctccaacgtgcagaggtgaatgtgcatgagcctgtgtatgctttcattcattcaagtattcagtgaacgcattgagcagccactatgt

SEQ ID NO: 15725 - DNA, 500 bp, Homo sapiens
acacaaattcactacagcaggagaaatgtgggtgccttcgaccatgagcgttagctatctggaaacacgttaagatggatactgtgcgtttaagggatgccagctgattgcagagtgtcctcaacaggctccagcactcatgccaccatgtctgtttccagggtcctctgccctgcggacctgtgagcagcccctccagtgtgagattttccaccagttgggatgggaccctgtgcggtacgacctcacgggctggctccacagagccaagcccaacctctcggccctggatgcaccccaggtcctgcaccagtcaaaaaggtgagttgggtcagggttggggacggggatggagcattggaggcactgtgttttccttcccacctaaactaggcagtcactacaacacagtgtgggagggccagcccaggaatcccatccctccataatggagcaaagaaccataacttgaattggagcagtgcagtgtctccctgggg

SEQ ID NO: 15726 - DNA, 500 bp, Homo sapiens
aggggctgtgaatgaaggggagcagctgggacacatgactgtagaggaggctttaggaagccgaggagcaggaagcaagaaggcttgttccctttgccaccacccaggccaaggctttcccaagaacctcctaaagctcctctctcttttccctcctccccaccagagaggagctgcggagtctattccaggcccgggccaagctgcctcctgtgtgccgggctgtggcaggcctggagggcacctcccagcaggccctgcagaggagccgcatggtgaggaggacctttgccagcagccttgccgcggtgaggaggaaagccccgtgctcccagatcaagctgcagatggtgagtgggcaccctgtctcatggtgtcctggccttcactgcctccatcctcatctcctctgggctgagtcatgtgcctacatcatctctaacctccccagcaaggccagaggggcgagtgtcaccccacgctccacagaggaggaaatg

SEQ ID NO: 15727 - DNA, 500 bp, Homo sapiens
gagcacaaatcaggctgtaggtgggagctccttggtgtgggacataggggccccaaagatgctcaggttgggcttaatgaatatttggagagggtccagtcccctttctgtgtctctgtgagacaactggccctgacctccctctatttggtctaggatgcgctgaccagcatgatcaaaaggtcccggctgcactttatccactgcctggtaccaaaccctgtggtggaaagcaggagtgggcaggaatctccaccaccaccgcagcctggtagagacaagcctggggcaggtggacctctggccctggatatcccagcactgagggtccagcttgctgggttccacatcctggaggctctgcgtctgcataggacaggtaagagacagctaggacacagcaccttgtctctgactcctgggacatgtccacccaccagtggcagccaagggatgggagcccctgccatgtgctaggagcttcacacccagcatcctgg

SEQ ID NO: 15728 - DNA, 500 bp, Homo sapiens
gaacacctctgggaagtgccaatcaaatatagtctcttaaattaacaaatggagaaactaaggtcccaagagatgagtccatgcagcaagttagtagccaggctaggaagcaggaccctgcactcctgtctaggggtttagggaactgggctgggtcttctcatctggactctgtgctcttctcctgcctgctcctacctccctaggctatgctgaccacatggggctcactcgcttccgccggcaattccaggtgctggacgctccactcctgaagaagctcatgtcgacctccgagggaatagatgaaaggaaggtaggtggagcacatgcgagaggggtgaaggccctagatatggatatgttggttattggacatgttccaaggctgggcacggtgagtggctcatgcctgtaatctcagtgctttgggatacccaggtgggtggatcacttgagtccaggagtacaagaccagcctgggcaatatgactttgact

SEQ ID NO: 15729 - DNA, 500 bp, Homo sapiens
gaggatgaaacaaattggtgtgtgtatgaaggcagagtggatggcacacagtaggtgctcagcacctgcaccttcctgtgtgaggtggggctctgttagccaaagctcacagacatgtggggtcatcctccgtcctggcgcatcagccatcgagccagcttgactttcccctttaggatcctcctaccttctatgctgtctaacttctctctaattttttccccaggccgtggaggagctcctggagaccctggatctggaaaagaaggcggtggctgtggggcacagccaagtgagtagagctgctttcttacaacattcgcccatcacatcagggacccagagatgacctgattcttgtcctacctcaattgtctattatctctgtacgtctcctttttcccaaactgaaggtagagctaatgattttctgccctgcctatcttacaaggtcctggagagacaatgtcataatatgagttgaaatcacactgggaaat

SEQ ID NO: 15730 - DNA, 500 bp, Homo sapiens
aatttagactcccccacctcccacttaaagggcaactgccaacaaatattgcaggtgggtgcaagagaagtggggtctgatttgcaagcacccccccattgtagacagccttcttcagcagaggactcacctgaaaccttccctctccccaggtttttctcaaggcaggtgtgatctccaggcttgagaagcagcgagagaagctggtatctcagagcatcgttctcttccaggcggcttgcaagggctttctgtctcgccaggaattcaagaagctgaaggtactgcatgccgttcccatgaggagtctgatccaacgggtctggagcgggcatagggtctgcctgtctttcaggatgataccggtgcaccgggtccaaggatccaacctgagcagtgagactttaagtgaggctttgcaagatgttatgactgtttctgggacattgacatcaaattatccatgaggtcggccttgcgctaggtagccatgaggttgt

SEQ ID NO: 15731 - DNA, 500 bp, Homo sapiens
taaggtatccagtcccttccaccgggaaataaccccacttcctccagcccctttgctaccctctgcctcctctccttcctttatcctcacctgggttggaaaggaccctccagtctgtgttctccttccctgcagattcgccgactggctgcacagtgcatccagaagaatgtggctgtgttcctcgcagtcaaggactggccatggtggcagctgcttggttccctccagcctctacttagtgccaccattggaactgagcagctccgagccaaggaggtcagtctatgtggcaggcagggtgctgggtggctactccccacaccctgctcctcctgtttgcatctagcaccctgtgcccctattcctgaatgttcttgatctaggaatgctcagcccaacagccttgatgccccttccagatgttcctctgcctccaacaacacagacaatcctccatcccatgcccagctcctctctaggctgtgggtgtttagaga

SEQ ID NO: 15732 - DNA, 500 bp, Homo sapiens
cactgtgcccagccaaaacctactttttacaagcaattttgaaatatacagtgcaccattatttgttatagtcaccattctgtgcaatagattgctaaggtttattcctcctaacggaaactttgtgccgtttgctcactcctaacacaggtggaacttaatctctggcctggaatggtttctgttcatgtgtttgtttttgtaggaggagcttacaacgctaagacggaagctagaaaaatcagagaagttgcggaatgaactccggcagaacacagatctgctagaaagcaaggtatccccatccctcctcttgggtccttgtggggggtctttatgtatgtgagatctgtttaatggggagaacaatgatatgcctgaaagcatgctaattgctttacaagcaccccagaattacctgtgaggcacatgctgttattgaacccattttacagtggaggaaattgaggccctgggatattaagtatcttcctcgaggc

SEQ ID NO: 15733 - DNA, 500 bp, Homo sapiens
accaataaaattctgaagtccatcctcttaacgagttgattatactcaagggttgctttcccatgatagtgatttgtccaaaggcgatcctgtgcatggggagagaagggttggtggctccatcgagtgaccgttccttgatcaccccattccccatctcagattgctgacttgacctctgaccttgccgatgagcgcttcaaaggtgatgtggcctgccaggtgctggagagtgagcgggcagagcggctacaggccttccgggaggtccaggagctcaaggtgagtggtcaggggtggccaggggtggctgaacacggtggctaaaaatggttgggtctgctccccgaccctctcattggagatcagtaagcttaagcaagatgcacaggttgactgactgctgggctcaaggtcctgggggacacttaggtctcctaaggcttggccttgggggtgttatgggtggatagtccctggctagagaggcgaataggaga

SEQ ID NO: 15734 - DNA, 500 bp, Homo sapiens
atttgggtgagaaatatgccgaaggtggctagcccatggtcctggattctgcatggctcagggctgtgcagagggtggccaatccgagccttggaagcacttcatgggtaagatgaccagcccatgtcttctgtccagctctagtttagaccttgagccctttcttctagagcaagcatgaacaagtccagaaaaaactgggagatgtgaataaacagttggaagaagcccagcagaaaattcagttgaatgacttggaaaggaatcccactggaggaggtgagcagcctgggacccttggggctggaaggtgatggacaaagttgtctttcccatttattcagtcactcatagagcactttttaggtgctagatattgcatgaggggctgcgactttggcagagcaaacaggcacagcgtactctcttggagcttacagtctaatggaataagcagatattaatcagataatccaacaatatcccaggtaacaaattat

SEQ ID NO: 15735 - DNA, 500 bp, Homo sapiens
ggaagcgttatttaaaactcagagttaaagcatagtttcttggtccaaggttgaggctcaagggctctgtgaatattgtgaaattgcatgccaagagccaagaaagtggaggagagccactcacactcttgccttacactcatttggcctcttatcctggtctccctgactccgttaaacagcagacgagtggcagatgcgcttcgactgtgctcagatggagaacgagttcctcagaaagcgtctgcagcaatgcgaggagaggctggactcggagctgacagccaggaaagagctggagcaaaaggtaagatgtggggatagtctgggccacagaagtgttagagagtgggcaggctctcacctccactgtgggtgatcgaggtattagctgagcctgaagagggaggaagaggacacaaaccccttaaggtttttccatctccactattattacaaatgctggtcactgtgagacatgaaaaatattgtctgtacat

SEQ ID NO: 15736 - DNA, 500 bp, Homo sapiens
aagtagcttcctggaggtgaccctggaggaaggtagtcaagacagggtctccccattccagcatctgctgttttctcattacacaccttggaaatagcaactccttgaaatacaaagtaaaaagctcgttccatgcccacagagccgggtaattcattctattactcttacagcttggggagttgcaaagtgcttatgacggggccaagaagatggctcaccaactgaagaggaagtgccaccatcttacctgtgaccttgaggatacctgcgtcctgctagagaaccaacaaagtcgaaaccatgagctggagaagaagcagaagaagtgagttgcatctctcaccatcacctgggctgccagggtgggctacattggagctggcgttttctggggtatccaggttctcctaactccctcacttcaactcccttgttttgctctaatcttcctccctgtcccgtcacaccttattcctgtatggttctcccaagaatcc

SEQ ID NO: 15737 - DNA, 500 bp, Homo sapiens
aagcattgagaaaaacttccaacttctcatactttctctatctctcttcttccttttgctctctttctaatggttcttgggaaactagcggcctctctgcagcccctccctgcccctgcctcaatcactcccctgcccacctgcctacggggccctgacacgtgctctgctttgcacaggtttgacctgcagctggcccaggccctaggtgagtcagtgtttgagaagggtctccgtgagaaagtgacccaggagaacaccagtgtccggtgggagctaggccagcttcagcagcagctgaaggtaagggatgggggacacagagctatcttggctcttggtggctaaatctcgggaaactgcatcgtgcacctgctgcaaatggtgacagagagaaaacttcacaagggtatcctggtctgtcaagcagctgaatcccagtgtgtcttaataaaatagcaaatggtggctggtaaattgataatcagactttgagcaag

SEQ ID NO: 15738 - DNA, 500 bp, Homo sapiens
tggggtccaggtggaaatggcaggcattggaaagtggaaaacgccactccagccccagttggttgtagaggtatccctgggggaggagggaggcatactcatgtgactccagatctctgtcctctttgtctctgtagcaaaaggagcaggaagcctcacagctgaagcagcaggtggagatgctacaggaccataaacgggagctgctggggtcaccctctctgggggaaaattgcgttgctggcttgaaggagaggctctggaagttggaatccagcgcccttgagcaacagaaaatccagagccagcaggaaaacaccatcaagcagctggagcaggtaggaaagccctgtctcagggcaacaccctgtcccatgtctccaatgcagagtgatgttattaaaatacaatgtgggtgcctcacttggctgctcctcatccttcaatggctccctattatcccagggaacctttaagctcctaagtctgacattcagatc

SEQ ID NO: 15739 - DNA, 500 bp, Homo sapiens
atggatagaggcaatatttaatctatttacccaccatttgtgatcttccaggatgcctagggcaataacttgactctcatttatgtattccaaaaatgagaaatgcaattggaatgccaaggatgacatggagggcttggagagttagagtgggtcaccctcacgtgctgtccttgctgcccccgcagctccgccagcggtttgagctggagatcgagcggatgaagcagatgcaccagaaggaccgtgaggaccaggaggaggaactggaggatgtccgtcagtcctgccagaagcgggtacgtgagcagtgaacacagctgtgcccttggatcctggcaggtctggcatggattccctcttccttagagcgaggagtaggacagggtctgggatctggggacaagctctttctgcaatcatctgagaccttagcttcgaagtgacttcaaaggtgtaggagcggaaatgcccatcttaaatatgatcttggaacttcc

SEQ ID NO: 15740 - DNA, 500 bp, Homo sapiens
tgttgtccagctcccaagcttttaggctcttaaattctcccacagagacactaccacccaatcactagggcagcctcatggaacaaagccacaagctctacattcctccgccttctgagggtccttgccttgtaggatgtgtctggatggagttcatttaccctgtgatgtttcttccctgtgtatccacagcttcatcagctggaaatgcagctggagcaagagtatgaagagaagcagatggtcctccatgagaagcaagatttggaaggcttgatcggaaccctctgtgaccaggtaagggggagacattggcagacattcagaggagtatctcagggacctatttgagagatgggctcatggagagaacagcctgagggataccctctcctccatcagctctgttcccaccatattcactggctcttcaaaggagaccttcaggtgcctgcaaacagcagggtttttgtaagaacccatggggaataaagagagtg

SEQ ID NO: 15741 - DNA, 500 bp, Homo sapiens
gttggtgccaatcccatttctcagttgaggaaactgaggctcggagaggagaatggtcttgtccaaggtcacacggtgtgagtggcagaggcaggatttaaaccagggaacctgattccggaaaacttagaccctggccactgctttgccacctaagctcatgggtctccctttggctttcagattggccatcgggactttgatgtggagaagcgacttcggagagacctcaggaggacacatgcactgttgtcagacgtgcagctccttctgggcaccatggaggatggcaagacatcagtcagcaaggaggagctggagaaagtgcacagccaggtgggtgtcacgggatccccttgagaatcaggctggggaggatgctacgacctgcagagaattgctgtccctcccaggtatgagcggaaccatggtgccaacctccaactttcacagatgtgcagggagatggggggcatttcagggctgtgagggtcatgtgg

SEQ ID NO: 15742 - DNA, 500 bp, Homo sapiens
ttgcctcgcctcgcctcccctcccctctcccttcccctccgctctcttcccccctcccctcccacctcccctcccctcccctcccacctcccctcccctcccacctcccctcccctcccaccttccctcccctccccacctcccttcccctcttcccttctcattttcttttcttctcttctccacctcttgcctggtccagctggagcagagtgaagccaagtgtgaggaggccttgaagacgcagaaggtgctcacagcggacctggagagcatgcacagcgagctggagaacatgacgcggaacaagagcctggtacctgtcccttcctgcagctgcagggacctgggccagcataggcctctgggagctagtgtgggcctagtgtgcgctcagcactataggaagtatgaggacatttattgtaaacctaccaggtagcaccttggaggtacagacatccattgtaggccttttatgtgctcagctctgtaagagg

SEQ ID NO: 15743 - DNA, 500 bp, Homo sapiens
cacacacaccaagctgttatacctaccacatgcattggtaaccacagccactcttaaacattgatggtcactcacctcacacacctataggcaagcccctctttgctcttcctctggaccttgctgcccatccctcaccctctcaccttgccttgaccactgatctgcctcccccaggtggatgagcagctgtacaggctgcagtttgagaaggcggacctcctgaagcgcatcgatgaggaccaggatgacctgaatgagctgatgcagaagcacaaggacctcattgctcaggtagtgaatgagaccttggtggaagaagctcagggacttggggtggggtgaatggggaatgttgagaaggtgatgtggttggactactccctggtcttaacatcttggagggataagtgcacagagatagttaggaattgtgcatttcctgtggtcctaatggaggacaatgtcaccttcagatggtgtgtgcatctctggaggac

SEQ ID NO: 15744 - DNA, 500 bp, Homo sapiens
gcttatataattggagtgactcagcgaacattgaaatgaaagatggtgaggaggatgtgagaggtaatttttgggaaacagctattatcatagaagctctgagagatgtagacatctgtgggtggggaaagtagggattttcaggggtggtttcccagcaaggcttgtggactcagggtgatatatatacatttttttttttgtctcaccagtctgctgctgacattgggcagatccaagaactgcagctgcagctggaggaagccaagaaggagaagcacaagctacaagaacaagtatgtgctcagagccatcctatagttgtattagtcagggttttcttagagggacagaactaataggatgtgtgtgtgtgtgtgtgtgtgtgtgtgtgtgtatgagtttattgtttgtttatttgtttatttatttttgagacaagagtctcactctgtcacccagactggagtgaagtggcgcgatcttggctcactgcaacc

SEQ ID NO: 15745 - DNA, 500 bp, Homo sapiens
attgacacctggccattcttgcttgtgcagacatttaacatgcagcacacctgagtagagaaggaggtggtgtgaatagctcctcccaccctcccaggctgggtcctgcacatgtctctgtcctggtatcagggacaacagatgtccaatagacttctctcatacttacagctgcaggtggctcagatgcgcatcgagtacctggaacagtccaccgtggatcgagccatcgtcagcaggcaggaggcggtcatctgtgacctagagaacaagacagagttccagaaggtgcagattaagagatttgaggtacgtagtgattcataaatagtgcctgggccaagagcagggagagcttttgtgtaagcttcatccatccttctactactcatctatctactcacatgccttcatctagatatacattactcatccacttctcacccaagctccctccctccttccatcatagcatcatccctcaagccacctacccattt

SEQ ID NO: 15746 - DNA, 500 bp, Homo sapiens
ttttgcatgttgttaattcttcatttttgtagcagacatcagtattcttatcctgattatgaaaacacaggaaactcggcaaaggatttatcttcctgaggctcccttgtttcatacccctggcctccaactccaaggtgggcatgtgtctctgcccctcccaggtcctggtgatccggcttcgggacagcctgatcaagatgggggaggagctttcacaggcggccacctccgagtcccagcagcgggagagcagccagtactaccagcggcgcctggaagagctgaaggccgacatggaagagctggtgcagcgggaggcagaggccagccggcggtgcatggagctggtgagtcctgtccccatcatgggctcttagcgactgagggtttgcaatgtggtagacccccctttcttaagacttctgaatgggagactcataggtttgggtcctgggcctcaggggtgtgcggaaagccaggagaaacaagaaggggag

SEQ ID NO: 15747 - DNA, 500 bp, Homo sapiens
aacttggaacacctggttgaggatcccataaatctgtccgcagagagagcctctcacggagaacttaccacttcataggtgctcagtgaacactaggctcagcctggggcgtgtctcttccccagtgcatgcatgggtggtgcatttcttgcccaaggccaacgtgtgtttgcatcttctgtccccaggagaagtacgtggaggaacttgcagcagtgaggcaaaccctccagacagacctggagacatccattcggcggattgccgacctgcaggctgccttggaagaagtggcatccagtgacagtgatactgagaggtaacttgctaggggctcggcggggctgggcgcagcaggtgggcggcatcctggggagctctatgccctttagccgggctggggccacattcactgggaaacccaaagatgttcgggggctggaggcacccctcgtttacttgggtaaggagagactggatgttgccctgctggtttaacc

SEQ ID NO: 15748 - DNA, 500 bp, Homo sapiens
tcttcacaagggttatctcacttactctgctccacaacagagccccattatttgccacattttaggaaggaagaaaggaagctcagggaaggcaagtgacttccctgagatcacacaggggcaaaggttggaagtgggattcacactcatgtctgtctaacgtcaataaccatgcttccaagcccctggcagcacgaggataacacactctttcttgtgcctcttactagtgtccagacggcagtggattgtggcagcagcggccgaaaagagatgtaagttaaccccaggtagaactgagcagctcacaagggtgagcccctggctctctctgtccagtttgcagagggaacatccatgtccacttggagaattatcagtgatgcccatgagactaatgccttcatggtcataacctatagcactaggaacatcgtattgaactgccctagttcttttagacagaaagaagcctatgccttctcatgctactgtcctca

SEQ ID NO: 15749 - DNA, 500 bp, Homo sapiens
aatctcagtaattccatctgtgtaactgtgacagcactggctcctacctctctgggatggcgagtgaggttatgcaggtatatcacttagcacaatgcctggcttatgctatgggtgaatatctaattattgctgttactgtgattgtcattgtgctgatggtgtcctgcaatcttattctagggataacgtctccatcctcagctcccagccagagggcagcctgcagtcctggttgagctgtactctgtccctggccacagatactatgaggactccttctcgacagtcagccaccagcagccgcatcctcagccccaggtaagagtatctccttgctgcctctggatggctaatagcttgaagaatctcagactttgaaagttgttgttcaagtctttcattgtctctggcataggcaaaaacaagcatggtcctgaaagtctggggtataactctgccacttcctagctgtgtgactttaggcagatcctttaccc

SEQ ID NO: 15750 - DNA, 500 bp, Homo sapiens
tctccccatttaccagacgactggggcctccacactaaggaggggcagggctggcagtgacgagggaaacctctcgctgagggttggggcaaagtcacccctggaaatcgaaggggccgctggtggtctcttgaggtccaccagcctcaaatgcatctcttcagacggtgttgggggcacaaccctactccccgaaaagtcgaaaacccaattcagttcctgcgagtccctcttagaatccagaccgagcatggggagaaaactgagctctccgaccacacccagggacatgctgttgtcgcccacactgcgtcctcggaggcggtgtctggagtcctctgtggacgatgcgggctgtccagaccttggaaaggagccgcttgttttccagaaccgccagtttgcccacctgatggaggaacctctaggcagtgacccattcagctggaaactcccaagcctcgactacgaacgcaagaccaaagtggacttcgatgact

SEQ ID NO: 15751 - DNA, 500 bp, Homo sapiens
gatcacttgaacccaggagctggaggctgcagtgagctatgattgcaccactgcacactagcctgagtgacaaagtgagaccctgcctccagaaaaagaaaaaccttacccatcctttgtcccattcatcaactctgacctatgtttgcttccagcctccttgaagctgcccttgaagacttcccgactctacaataacttggagacagagagactggccaggcctccccggtggccagagccagccagcatggccaccctcaagaggcgagatgagcccacagaggcatatcctgcggggatgctgggctcccagtgtggttggcctgaacaaaataaagtgttgactcctgggcatctgtgccttctctatggccttgctacctgggattccagagagttgatggggtgcagataggggtaggactgttagaatagaaccaacccaaactgtgtgtagtttggggtgtatacttctatttctcttcctacatgtctac

SEQ ID NO: 15752 - DNA, 1000 bp, Homo sapiens
tgatttttttttttttttttgagatggagtctctctctgtcacccaggctggagtgcagtggcgcgatctcggcttactgcaagctccgcctgtagctgggactacaggcgcccaccaccacgcccggctaattttgtttttgtatttttagtagagacggggtttcactgtgttagccaggatggtctcaatctcctgacctcgtgatatgcccacctcggcttcccaaagtgccgggattacagacgtgagccaccgtgccaggcccaaagcacttttttatagcccctagtttgctgttgtgtctgtttcctctacggcccgcacagcctgggtttgaattctggctctccatggccttgggcaagttggttaactttttgtgtctcaatttccccacttgtaaagtggggctggggaaaaaccctacctcatagggaacattaagtgagttcatgaaagccctcggtgtgtggcatgcgataaccactacctaagcataaggtatgtttacatgcactggttgtttaccacgacgcaccagcattcattcaagttattttcttccagagtctgcctggaatgtagaaccggccagctctcctcctcaaacagttcctgcaacctctggttatctgtgtgggcagaggcgggagtgtgggtgtgtggccctgccctgggacagggatgacgagagagcatgtgcttgtgtccagagctgtccccttccctgctcaggggccaccaaatatgtccatggtctctgctgcctggtcaacggccaccccgggctgccgtctcctggccagacctggagctcacaagctaattttagaaatgactggtcgactcagctgctgctatcacattggcccagaaggagggtggggggaggacgggtcggggaggggcagtaaggggaagggatgtgtgtcggtgtgtgtggagagggtgctccttcgctcctgctttcccggctcggtggggtcccttcgcggc

SEQ ID NO: 15753 - protein, 1695 aa, Mus musculus
AAEEAWYETEKVWLVHRDGFSLASQLKSEELSLPEGKARVKLDHDGAILDVDEDDIEKANAPSCDRLEDLASLVYLNESSVLHTLRQRYGASLLHTYAGPSLLVLSTRGAPAVYSEKVMHMFKGCRREDMAPHIYAVAQTAYRAMLMSRQDQSIVLLGSSGSGKTTSFQHLVQYLATIAGTSGTKVFSVEKWQALSTLLEAFGNSPTIMNGSATRFSQILSLDFDQAGQVASASIQTMLLEKLRVARRPASEATFNVFYYLLACGDATLRTELHLNHLAENNVFGIVPLSKPEEKQKAAQQFSKLQAAMKVLAISPEEQKTCWLILASIYHLGAAGATKEAAEAGRKQFARHEWAQKAAYLLGCSLEELSSAIFKHQLKGGTLQRSTSFRQGPEESGLGEGTKLSALECLEGMASGLYSELFTLLISLVNRALKSSQHSLCSMMIVDTPGFQNPEWGGSARGASFEELCHNYAQDRLQRLFHERTFLQELERYKEDNIELAFDDLEPVADDSVAAVDQASHLVRSLAHADEARGLLWLLEEEALVPGATEDALLDRLFSYYGPQEGDKKGQSPLLRSSKPRHFLLGHSHGTNWVEYNVAGWLNYTKQNPATQNAPRLLQDSQKKIISNLFLGRAGSATVLSGSIAGLEGGSQLALRRATSMRKTFTTGMAAVKKKSLCIQIKLQVDALIDTIKRSKMHFVHCFLPVAEGWPGEPRSASSRRVSSSSELDLPPGDPCEAGLLQLDVSLLRAQLRGSRLLDAMRMYRQGYPDHMVFSEFRRRFDVLAPHLTKKHGRNYIVVDEKRAVEELLESLDLEKSSCCLGLSRVFFRAGTLARLEEQRDEQTSRHLTLFQAACRGYLARQHFKKRKIQDLAIRCVQKNIKKNKGVKDWPWWKLFTTVRPLIQVQLSEEQIRNKDEEIQQLRSKLEKVEKERNELRLSSDRLETRISELTSELTDERNTGESASQLLDAETAERLRTEKEMKELQTQYDALKKQMEVMEMEVMEARLIRAAEINGEVDDDDAGGEWRLKYERAVREVDFTKKRLQQELEDKMEVEQQSRRQLERRLGDLQADSDESQRALQQLKKKCQRLTAELQDTKLHLEGQQVRNHELEKKQRRFDSELSQAHEETQREKLQREKLQREKDMLLAEAFSLKQQMEEKDLDIAGFTQKVVSLEAELQDISSQESKDEASLAKVKKQLRDLEAKVKDQEEELDEQAGSIQMLEQAKLRLEMEMERMRQTHSKEMESRDEEVEEARQSCQKKLKQMEVQLEEEYEDKQKALREKRELESKLSTLSDQVNQRDFESEKRLRKDLKRTKALLADAQIMLDHLKNNAPSKREIAQLKNQLEESEFTCAAAVKARKAMEVEMEDLHLQIDDIAKAKTALEEQLSRLQREKNEIQNRLEEDQEDMNELMKKHKAAVAQASRDMAQMNDLQAQIEESNKEKQELQEKLQALQSQVEFLEQSMVDKSLVSRQEAKIRELETRLEFEKTQVKRLENLASRLKETMEKLTEERDQRAAAENREKEQNKRLQRQLRDTKEEMSELARKEAEASRKKHELEMDLESLEAANQSLQADLKLAFKRIGDLQAAIEDEMESDENEDLINSEGDSDVDSELEDRVDGVKSWLSKNKGPSKAPSDDGSLKSSSPTSHWKPLAPDPSDDEHDPVDSISRPRFSHSYLSDSDTEAKLTETSA

SEQ ID NO: 15754 - protein, 1581 aa, Homo sapiens [sequence omitted]

SEQ ID NO: 15755 - protein, 99 aa, Homo sapiens
RLDLEATKARLSSLESLLHQLTLDQAARPQETQEGLQRELGTLRRERDQLETQTRELETAYSNLLRDKSVLEEEKKRLRQENENLARRLESSSQEVARL

What is claimed is:

1. An isolated nucleic acid comprising:
a polynucleotide having a sequence selected from the group consisting of (i) the nucleotide sequence of SEQ ID NO:1, (ii) the nucleotide sequence of SEQ ID NO:2, (iii) a nucleotide sequence that is a degenerate variant of the nucleotide sequence of SEQ ID NO:2, (iv) a nucleotide sequence at least 90% identical in sequence to SEQ ID NO:2, (v) a nucleotide sequence that encodes a polypeptide with the amino acid sequence of SEQ ID NO:3, (vi) a nucleotide sequence that encodes a polypeptide at least 90% identical in sequence to SEQ ID NO:3, and (vii) a nucleotide sequence that is the complete complement of the nucleotide sequence of any one of (i)–(vi), wherein said nucleic acid encodes a polypeptide having ATPase activity or a polypeptide capable of binding calmodulin.

2. An isolated nucleic acid comprising:
a polynucleotide having a sequence selected from the group consisting of (i) the nucleotide sequence of SEQ ID NO:1, (ii) the nucleotide sequence of SEQ ID NO:2, (iii) a nucleotide sequence that is a degenerate variant of the nucleotide sequence of SEQ ID NO:2, (iv) a nucleotide sequence at least 95% identical in sequence to SEQ ID NO:2, (v) a nucleotide sequence that encodes a polypeptide with the amino acid sequence of SEQ ID NO:3, (vi) a nucleotide sequence that encodes a polypeptide at least 95% identical in sequence to SEQ ID NO:3, and (vii) a nucleotide sequence that is the complete complement of the nucleotide sequence of any one of (i)–(vi), wherein said nucleic acid encodes a polypeptide having ATPase activity or a polypeptide capable of binding calmodulin.

3. An isolated nucleic acid comprising:
a polynucleotide having a sequence selected from the group consisting of (i) the nucleotide sequence of SEQ ID NO:1, (ii) the nucleotide sequence of SEQ ID NO:2, (iii) a nucleotide sequence that is a degenerate variant of the nucleotide sequence of SEQ ID NO:2, (iv) a nucleotide sequence at least 99% identical in sequence to SEQ ID NO:2, (v) a nucleotide sequence that encodes a polypeptide with the amino acid sequence of SEQ ID NO:3, (vi) a nucleotide sequence that encodes a polypeptide at least 99% identical in sequence to SEQ ID NO:3, and (vii) a nucleotide sequence that is the complete complement of the nucleotide sequence of any one of (i)–(vi), wherein said nucleic acid encodes a polypeptide having ATPase activity or a polypeptide capable of binding calmodulin.

4. The isolated nucleic acid of any one of claims 1–3, wherein said nucleic acid encodes a polypeptide having ATPase activity.

5. The isolated nucleic acid of any one of claims 1–3, wherein said nucleic acid encodes a polypeptide capable of binding calmodulin.

6. The isolated nucleic acid of any one of claims 1–3, wherein said nucleic acid is expressed in skeletal muscle and heart muscle.

7. The isolated nucleic acid of any one of claims 1–3, further comprising at least one expression control element, wherein said polynucleotide is operably linked to said at least one expression control element.

8. The isolated nucleic acid of any one of claims 1–3, attached to a substrate.

9. A microarray wherein at least one probe of said array is a nucleic acid according to any one of claims 1–3.

10. A replicable vector comprising the isolated nucleic acid of any one of claims 1–3.

11. A replicable vector comprising the isolated nucleic acid of claim 7.

12. An expression vector comprising the isolated nucleic acid of any one of claims 1–3.

13. A host cell transformed to contain the nucleic acid of any one of claims 1–3, or the progeny thereof containing said nucleic acid.

14. A host cell transformed to contain the replicable vector of claim 10, or the progeny thereof containing said replicable vector.

15. A host cell transformed to contain the replicable vector of claim 11, or the progeny thereof containing said replicable vector.

16. A host cell transformed to contain the expression vector of claim 12, or the progeny thereof containing said expression vector.

17. A method for producing a polypeptide, the method comprising:
   culturing the host cell of claim 15 under conditions in which the protein encoded by said nucleic acid is expressed.

18. The method of claim 17, further comprising the step of:
   isolating said expressed protein.

19. A method for producing a polypeptide, the method comprising:
   culturing the host cell of claim 16 under conditions in which the protein encoded by said nucleic acid is expressed.

20. The method of claim 19, further comprising the step of:
   isolating said expressed protein.

21. The isolated nucleic acid of claim 4, wherein said nucleic acid is expressed in skeletal muscle and heart muscle.

22. The isolated nucleic acid of claim 5, wherein said nucleic acid is expressed in skeletal muscle and heart muscle.

23. The isolated nucleic acid of claim 4, further comprising at least one expression control element, wherein said polynucleotide is operably linked to said at least one expression control element.

24. The isolated nucleic acid of claim 5, further comprising at least one expression control element, wherein said polynucleotide is operably linked to said at least one expression control element.

25. The isolated nucleic acid of claim 4, attached to a substrate.

26. The isolated nucleic acid of claim 5, attached to a substrate.

27. A microarray wherein at least one probe of said array is a nucleic acid according to claim 4.

28. A microarray wherein at least one probe of said array is a nucleic acid according to claim 5.

29. A replicable vector comprising the isolated nucleic acid of claim 4.

30. A replicable vector comprising the isolated nucleic acid of claim 5.

31. A replicable vector comprising the isolated nucleic acid of claim 23.

32. A replicable vector comprising the isolated nucleic acid of claim 24.

33. An expression vector comprising the isolated nucleic acid of claim 4.

34. An expression vector comprising the isolated nucleic acid of claim 5.

35. A host cell transformed to contain the nucleic acid of claim 4, or the progeny thereof containing said nucleic acid.

36. A host cell transformed to contain the nucleic acid of claim 5, or the progeny thereof containing said nucleic acid.

37. A host cell transformed to contain the replicable vector of claim 29, or the progeny thereof containing said replicable vector.

38. A host cell transformed to contain the replicable vector of claim 30, or the progeny thereof containing said replicable vector.

39. A host cell transformed to contain the replicable vector of claim 31, or the progeny thereof containing said replicable vector.

40. A host cell transformed to contain the replicable vector of claim 32, or the progeny thereof containing said replicable vector.

41. A host cell transformed to contain the expression vector of claim 33, or the progeny thereof containing said expression vector.

42. A host cell transformed to contain the expression vector of claim 34, or the progeny thereof containing said expression vector.

43. A method for producing a polypeptide, the method comprising:
   culturing the host cell of claim 39 under conditions in which the protein encoded by said nucleic acid is expressed.

44. A method for producing a polypeptide, the method comprising:
   culturing the host cell of claim 40 under conditions in which the protein encoded by said nucleic acid is expressed.

45. The method of claim 43, further comprising the step of:
   isolating said expressed protein.

46. The method of claim 44, further comprising the step of:
   isolating said expressed protein.

47. A method for producing a polypeptide, the method comprising:
   culturing the host cell of claim 41 under conditions in which the protein encoded by said nucleic acid is expressed.

48. A method for producing a polypeptide, the method comprising:
   culturing the host cell of claim 42 under conditions in which the protein encoded by said nucleic acid is expressed.

49. The method of claim 47, further comprising the step of:
   isolating said expressed protein.

50. The method of claim 48, further comprising the step of:
   isolating said expressed protein.

* * * * *